United States Patent 7,745,391 (HUMAN THROMBOSPONDIN POLYPEPTIDE) - sequence listing, part 262

SEQ ID NO: 736225 - DNA, 6643 bp, Homo sapiens
  misc_feature (121)..(122): n is a, c, g, or t
  misc_feature (233)..(236): n is a, c, g, or t
  misc_feature (406)..(406): n is a, c, g, or t
  misc_feature (683)..(683): n is a, c, g, or t
  misc_feature (948)..(948): n is a, c, g, or t
  misc_feature (977)..(977): n is a, c, g, or t
  misc_feature (1042)..(1042): n is a, c, g, or t
  misc_feature (1067)..(1067): n is a, c, g, or t
  misc_feature (1271)..(1271): n is a, c, g, or t
  misc_feature (1320)..(1321): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggattgctcctgactctgatgggcatcctcactcctcagacatttccaatctcccccacttcactgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatccnaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatatttgtttagagggtgggcattgttttaggttttaccccaaaaaacaaattctttttttcaggccaacttttaggaaaaatatttcttttttaaaaaaaacca

SEQ ID NO: 736226 - DNA, 6192 bp, Homo sapiens
  misc_feature (121)..(122): n is a, c, g, or t
  misc_feature (233)..(236): n is a, c, g, or t
  misc_feature (406)..(406): n is a, c, g, or t
  misc_feature (683)..(683): n is a, c, g, or t
  misc_feature (948)..(948): n is a, c, g, or t
  misc_feature (977)..(977): n is a, c, g, or t
  misc_feature (1042)..(1042): n is a, c, g, or t
  misc_feature (1067)..(1067): n is a, c, g, or t
  misc_feature (1271)..(1271): n is a, c, g, or t
  misc_feature (1320)..(1321): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggattgctcctgactctgatgggcatcctcactcctcagacatttccaatctcccccacttcactgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatccnaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctcaacgctgcatgacctatctaggtcgctctctacagacattcccagtgccttctaagccaagacatg

SEQ ID NO: 736227 - DNA, 6135 bp, Homo sapiens
  misc_feature (121)..(122): n is a, c, g, or t
  misc_feature (233)..(236): n is a, c, g, or t
  misc_feature (406)..(406): n is a, c, g, or t
  misc_feature (683)..(683): n is a, c, g, or t
  misc_feature (948)..(948): n is a, c, g, or t
  misc_feature (977)..(977): n is a, c, g, or t
  misc_feature (1042)..(1042): n is a, c, g, or t
  misc_feature (1067)..(1067): n is a, c, g, or t
  misc_feature (1271)..(1271): n is a, c, g, or t
  misc_feature (1320)..(1321): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggattgctcctgactctgatgggcatcctcactcctcagacatttccaatctcccccacttcactgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatccnaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaacacaacacaccggcgttggcttggagagctccacaagggggcgaggggggtcccctccagggaaatgccttgaaaacgggagacatgtggcacctttacccggcgcggaaacgatggtcaaggtccacaacggagaaagtttttccca

SEQ ID NO: 736228 - DNA, 5852 bp, Homo sapiens
  misc_feature (121)..(122): n is a, c, g, or t
  misc_feature (233)..(236): n is a, c, g, or t
  misc_feature (406)..(406): n is a, c, g, or t
  misc_feature (683)..(683): n is a, c, g, or t
  misc_feature (948)..(948): n is a, c, g, or t
  misc_feature (977)..(977): n is a, c, g, or t
  misc_feature (1042)..(1042): n is a, c, g, or t
  misc_feature (1067)..(1067): n is a, c, g, or t
  misc_feature (1271)..(1271): n is a, c, g, or t
  misc_feature (1320)..(1321): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggattgctcctgactctgatgggcatcctcactcctcagacatttccaatctcccccacttcactgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatccnaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgcttactgtcattgcccgcttgttgaccagccggaattgtcctg

SEQ ID NO: 736229 - DNA, 7023 bp, Homo sapiens
  misc_feature (121)..(122): n is a, c, g, or t
  misc_feature (233)..(236): n is a, c, g, or t
  misc_feature (406)..(406): n is a, c, g, or t
  misc_feature (683)..(683): n is a, c, g, or t
  misc_feature (948)..(948): n is a, c, g, or t
  misc_feature (977)..(977): n is a, c, g, or t
  misc_feature (1042)..(1042): n is a, c, g, or t
  misc_feature (1067)..(1067): n is a, c, g, or t
  misc_feature (1271)..(1271): n is a, c, g, or t
  misc_feature (1320)..(1321): n is a, c, g, or t
  misc_feature (5627)..(5627): n is a, c, g, or t
  misc_feature (5634)..(5634): n is a, c, g, or t
  misc_feature (6905)..(6905): n is a, c, g, or t
  misc_feature (6920)..(6921): n is a, c, g, or t
  misc_feature (7018)..(7018): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggattgctcctgactctgatgggcatcctcactcctcagacatttccaatctcccccacttcactgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatccnaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcaggggggggggggggtttttgggggggaaaaaaggaaaaaaaagggtttttnccccccnccttttgggaaaaaaaaaacccccccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaaaaaaaactgagttttacccatctttataaatgatgctacactactaaactgtgatgcatttgacatctgtcattcntctgtggctgaccanncatgcaacattctttatattttgggcacttcattactgtgagaagcttaagaccttctttccacccgtgaacataagggggccacatacttggtttnccaat

SEQ ID NO: 736230 - DNA, 6905 bp, Homo sapiens
  misc_feature (121)..(122): n is a, c, g, or t
  misc_feature (233)..(236): n is a, c, g, or t
  misc_feature (406)..(406): n is a, c, g, or t
  misc_feature (683)..(683): n is a, c, g, or t
  misc_feature (948)..(948): n is a, c, g, or t
  misc_feature (977)..(977): n is a, c, g, or t
  misc_feature (1042)..(1042): n is a, c, g, or t
  misc_feature (1067)..(1067): n is a, c, g, or t
  misc_feature (1271)..(1271): n is a, c, g, or t
  misc_feature (1320)..(1321): n is a, c, g, or t
  misc_feature (6787)..(6787): n is a, c, g, or t
  misc_feature (6802)..(6803): n is a, c, g, or t
  misc_feature (6900)..(6900): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggattgctcctgactctgatgggcatcctcactcctcagacatttccaatctcccccacttcactgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatccnaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccatcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaaaaaaaactgagttttacccatctttataaatgatgctacactactaaactgtgatgcatttgacatctgtcattcntctgtggctgaccanncatgcaacattctttatattttgggcacttcattactgtgagaagcttaagaccttctttccacccgtgaacataagggggccacatacttggtttnccaat

SEQ ID NO: 736231 - DNA, 6910 bp, Homo sapiens
  misc_feature (121)..(122): n is a, c, g, or t
  misc_feature (233)..(236): n is a, c, g, or t
  misc_feature (406)..(406): n is a, c, g, or t
  misc_feature (683)..(683): n is a, c, g, or t
  misc_feature (948)..(948): n is a, c, g, or t
  misc_feature (977)..(977): n is a, c, g, or t
  misc_feature (1042)..(1042): n is a, c, g, or t
  misc_feature (1067)..(1067): n is a, c, g, or t
  misc_feature (1271)..(1271): n is a, c, g, or t
  misc_feature (1320)..(1321): n is a, c, g, or t
  misc_feature (6792)..(6792): n is a, c, g, or t
  misc_feature (6807)..(6808): n is a, c, g, or t
  misc_feature (6905)..(6905): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggattgctcctgactctgatgggcatcctcactcctcagacatttccaatctcccccacttcactgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatccnaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaaaaaaaactgagttttacccatctttataaatgatgctacactactaaactgtgatgcatttgacatctgtcattcntctgtggctgaccanncatgcaacattctttatattttgggcacttcattactgtgagaagcttaagaccttctttccacccgtgaacataagggggccacatacttggtttnccaat

SEQ ID NO: 736232 - DNA, 5734 bp, Homo sapiens
  misc_feature (5616)..(5616): n is a, c, g, or t
  misc_feature (5631)..(5632): n is a, c, g, or t
  misc_feature (5729)..(5729): n is a, c, g, or t
aaaaatctaggactctcctagaatccttgataaaataatctgaaggaagagagatggggaaaaaacagttgaggtgtctttccagggagcttatccagactgcctccaggggagatgttatggccctaaccataggtgttgtctcaatccaatataattaggggtcaagcccagtcaaacccttctcagccctcaagccctccaagttgcatcacaaatgccacctcctccatgtggtctctcctgatggtcccccaccccttccaaccaggtgggactttccttctgggcattcttcccatgcccgggagctgaagggatgggcatggtgactggctgggttggctccggatgcgtgcccctacgcctctccttgctccctcagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaaaaaaaactgagttttacccatctttataaatgatgctacactactaaactgtgatgcatttgacatctgtcattcntctgtggctgaccanncatgcaacattctttatattttgggcacttcattactgtgagaagcttaagaccttctttccacccgtgaacataagggggccacatacttggtttnccaat

SEQ ID NO: 736233 - DNA, 3932 bp, Homo sapiens
  misc_feature (3814)..(3814): n is a, c, g, or t
  misc_feature (3829)..(3830): n is a, c, g, or t
  misc_feature (3927)..(3927): n is a, c, g, or t
gtatccaggctgtgccactgaatacccatgtaaccttggagatgtcacattcccttcctgagcctccattttctcaccacaaaattaggatgccatctccactgctgtaggagtgggatgtgagtaaagaaactagcccagggcctagcaaactgcacttacaactgcgatgatcccatggtgaggatttagactcacattctcaaggagaaatgggggaagtgagtactgaggagaggagaactgaagcaacaggggaagcaggctcagcagggagcctgcaggctgcggtggtgaagagaggcagggggcaggaggggctggtacaggtgccaggggtcagctgtctctgtccccacccaccctccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaaaaaaaactgagttttacccatctttataaatgatgctacactactaaactgtgatgcatttgacatctgtcattcntctgtggctgaccanncatgcaacattctttatattttgggcacttcattactgtgagaagcttaagaccttctttccacccgtgaacataagggggccacatacttggtttnccaat

SEQ ID NO: 736234 - DNA, 1463 bp, Homo sapiens
cttgtgaagaacaacaaaactgtcaacttttaattttgccaaactagagcatttaataaaatagccatttattatcagcatcagctctcaaatacattgtaacactaaaatgagggcacaccatctccaaataagacgatctttaaatgagcttttatacaaaactcactatgctgtcctttttggtcatttttccttggactaatgataactttggcctgagctggctaggcttccaattatgaatgtggctattctagtgagaaggaatgagatgggggaagagtatcaagttgacctgaaggctatgctgtttctttctgctccagtgatgccttctagctctaaatccttcaatttttcaactgccatctctcttattaaatgggtttaataataaaagataacctgagatccatggagcactgggtacagtgctgaaaatgttcatcagaccgtgatgctgctgatccctgccctcatgactatgggtaaattaacattgaactttggacatgaagatgactaatttttggagggagataaccctatatcaaattgttattgtcatagaacatggatttagttgcttatgaaaatataaaaacatgtatttaagctgttgagttacaattttaaagaaaaccaacaccctaaaatattttttttcacatatagagaactcactttgaaaatgtttttgtatcttaactgggagtttgtgataatctagattgttcacaatgactgtgacaccttgtcccatttcttagcatctttttcatattttccatctatccctgaaactaatgtcctgcatttttcaacaggacctcaggaatctgtaactaagcaccatggaactccaaaatgcttttggtcctggaaaggtgaagaccttgatcctagctatttagcatgaattacacactatccttaatctcaacagatttgtgaaaagacacaaaaagtaatgaggaccaaaaaaaaaattctttcactgttatattgcttcatatgacatcattttgttatcttccttctttattttttaaaaagatttattaagtgagcaggaaaatacatgattgaacaaatggaaactacagggtgtgccctttacaagactgagtgaaacaacagattaatcagaaggcatgtgtcaattttctacaatgaaacttcatgcaacattcagtggagctgaatatatacagatgttagaggcttcccagggaggcagaattgttgtccttggaagattgttaagacccaaatgtcattaggctgtcttcaagctgcatttggcaggaggatactttcactgttgtttatttcttgtttcagaaaaaaaaaattgtttttttaaacatttagaccagaaaacaaaattcagaatccccacccacatccaataactgcatttattgcaatgccaatagcttaaaatggatcattatctg

SEQ ID NO: 736235 - DNA, 770 bp, Homo sapiens
  misc_feature (697)..(697): n is a, c, g, or t
caacacgcctgaagtgatgtttaattaatgatgataatggacggggatttgagaaatcttttcattttcgcttgctaataataattttagtcagagttacaagtagggttcttgaaaaaaaaacatatctgacgtataaagacaatggattcagggatacttgatcaaattgtttctgatgaatgaggacccacactctctgctgtcacaaacaggaggtggggcccaagaaacagtggtgaaagatgtttcaggttgatctgcaatggattattcacagcaacaatgaggatgatacagtttcagctttttcctccagcaaggccttactgacaacctactgtctgcccaatagtagggcttgcaaagattcttctaattataaatggagcaaaaaattctgaccttcaatttgaaaatcatatacttacaccttcttttgttagcaattgcacttcatcgatataaggctttagaagacaaaatcctagacatcatttgatttttagaaaatccttctgaggagataaatatctggtttcatcacccaggaggctcattattcacctcatggaggtgtgatgtcttcaagacattaacaatgtcattcagttcatccactttgattcatacatgcccatttcagaaacatatctcttgtatataaaactgaatttccttgaatgttttcaattgnttatttggcatgctcataaatgctgtgagacactggttattgtcagtcaaacactttcagattgtagatgctt

SEQ ID NO: 736236 - DNA, 548 bp, Homo sapiens
attttgtaatgcactttaaaatatttgtgccatttaaataatgacaaagcaatcaatgcatacatttcaatggagacagtatacaaagttaaagcaactgatacatatatttcagtggagacagtaggataacagtgttagcaaatatgtgtcatctctttaaatttgggaggaatcagaagctaaagatttaaaacaaataaaacatacctgaagaaaagtagcaatttctgaaattgtagtaatcttggaatggttatcaaacctagcaaataatacttaataagtgttacctaatatacctaattggaatgtttgtttaaaatattaaattaatttatactgaaagttttaactgcaatttcataattcatgaattctataaaagaaatctccctcactaaaaatatgatcaatcaaaactaccagttttgcacaccaatcccaagtttaagcatattttgtatttaaagttataatttaattatgatactgtccccctaatatggaaaataagttacaaaattctttttttttttttttttttt

SEQ ID NO: 736237 - DNA, 759 bp, Homo sapiens; identical to SEQ ID NO: 87106

SEQ ID NO: 736238 - DNA, 2115 bp, Homo sapiens
ctcgacacccaaacctcaacataaatcaaacactttcccgggcagagaatgtctgtgtcaggcaagaattagagacaagcggtcagcagagcctcagtgctgatcgtcggagcttgggagcaggaagatgtcgaatgaacttgatttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggggaaacttctctcctccacccacgcctgtctcgccaccccccacctgactgtcttgaatgttcccatcctgtgactcaagtgaggaacatgggttttggagatggattttggaggcagagggacctggattcaaatcccagccccaccaccgtcaacagcctgcacttcactgtaaactcggaatgacacacccacctggaggagaggtggaaggacgacggcaggtcacatctgagagctctcagctcagagtatgtggcccctgaatacattctggctattactttgcattt

SEQ ID NO: 736239 - DNA, 1836 bp, Homo sapiens
gtgagtaaacatcggtggatacctgccgctctcagagcgtggaggctggatggggtttcctggagggggaagagcggggaggccggcaccgggattcacagagcaatttgtaagggtaaatgaatgggctgacgatcttactttggcgtgtcaaggcaagccccagtctcaagctagagtttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggtgaggccagggctggggtctcgggaaggagccgagagagggtcctggctcctaggtggggcctgccttagcacagaccagtggggagcagcctgcccctcagccagtttcaagacctttattgaatcataggggtttaaacatgtatatatggtcctatagcttcagtgacctattgtattgaagagaagaatgttatgaagaaacagatttcgtaaccattaaaacgttcatgcttagggcacacaaagagga

SEQ ID NO: 736240 - DNA, 2801 bp, Homo sapiens
gtgagtaaacatcggtggatacctgccgctctcagagcgtggaggctggatggggtttcctggagggggaagagcggggaggccggcaccgggattcacagagcaatttgtaagggtaaatgaatgggctgacgatcttactttggcgtgtcaaggcaagccccagtctcaagctagagtttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacatta

SEQ ID NO: 736241 - DNA, 1787 bp, Homo sapiens
aaagttgccccacctctctgagcattggcttccccatctgtgaaagaggagtgctgatgtttgccttctaggggcctagtgaggcttaagggtgagcagcaggcacacagaaagctagaaatacaggatcactgtgggacggtggggctggccacctgggcaggccacttacccagcggccccctctgtctccaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacatta

SEQ ID NO: 736242 - DNA, 1924 bp, Homo sapiens
gctggcgtggacgtttgtggtggggcgtgttggtccgcgctctcagaactgtgctgggaaggatggtagggcgactggggctcacctccgcaccgttgtaggacccggggtagggttttgagcccgtgggagctgccccacgcggcctcgtcctgccaacggtcggatggcggagacgaaggacgcagcgcagatgttggtgaccttcaaggatgtggctgtgacctttacccgggaggagtggagacagctggacctggcccagaggaccctgtaccgagaggtgatgctggagacctgtgggcttctggtttcactagggcatcgggttcccaaaccagagttggtccacctgctagagcatgggcaggagctgtggatagtgaagagaggcctctcacatgctacctgtgcaggtgacagagcacaagttcataccagagagccaaccacttacccgccagtcttatctgagcgggcctttctccggggaagcctgactctggaatcttcaacctcaagtgattcgaggttggggagagctagggatgaggaagggcttttggaaatgcagaaaggtaaagtgacaccggagacagacctccacaaggagacccatcttgggaaagtgagccttgaaggtgaaggtttggggacagatgatggtctgcactccagggcattacaagagtggttatcagcagatgttctccatgaatgtgactcacagcaaccagggaaagacgccttgattcatgcagggacaaacccctacaaatgcaagcagtgtgggaaaggttttaacaggaagtggtatctcgttcgacatcagagggttcacactggaatgaaaccctatgaatgcaatgcatgtgggaaagcctttagccagagctcaactctcattcggcactacctcatccacaccggggagaaaccatacaagtgccttgagtgtgggaaggccttcaaacgcaggtcgtacctcatgcagcaccatccaatccacactggagagaaaccctatgagtgtagtcaatgtcgaaaggccttcacccaccggtctacttttattcgccataataggacccacactggagaaaagccctttgagtgcaaagaatgtgagaaagcctttagcaatagagcccacctaattcaacattacatcatccacactggagagaagccctatgattgcatggcatgtggaaaggccttcagatgcagctcagaactcatacagcaccagcggattcacactggggagaagccctatgaatgcacccagtgtgggaaagcctttcaccggagcacgtacctcattcagcactctgtcatccacactggggagatgccctacaagtgtatcgagtgtgggaaggccttcaaacgcaggtcacaccttctgcagcaccaaagggtccatacatgagagaaccctattgctgcaatgaatacagcaaggcctttacccactgttattttatcattcataatgggacccacactgtaggaagaagtccttcgagtgcaaagaatgtcaggaaacttttcattttttttgtcagctctttcttaactaacacatgagcagtcactttggagagaagccctgtgaatacagtgaatgtaaggatcccttcagtcaccactcagttctcactcattgcagaaggattcataccagggggaaatgtggaaggcattccatcaacatcagagaactcatgctggagaaagacattccaaatataactattaaggacagtctttggccagagcagaaatcttactatctgagaatcataatgaaaagttactacataattgttattgatgtgagaaaactttgtgaccaggttgtcacttgcttgtcctataaagagccatgctggaatttgacccaccttgggattttctc

SEQ ID NO: 736243 - DNA, 1799 bp, Homo sapiens
gcagtatctgcctcccctttgagccctgcacggaagtcagcccaaaggagacctagttgattcagacctggatctctctgcacattgactagagactgagtgacaggttctgatcctatgcgacaacacaaggccaatagcattacttctgtttgactttccagatgttggtgaccttcaaggatgtggctgtgacctttacccgggaggagtggagacagctggacctggcccagaggaccctgtaccgagaggtgatgctggagacctgtgggcttctggtttcactaggtgacagagcacaagttcataccagagagccaaccacttacccgccagtcttatctgagcgggcctttctccggggaagcctgactctggaatcttcaacctcaagtgattcgaggttggggagagctagggatgaggaagggcttttggaaatgcagaaaggtaaagtgacaccggagacagacctccacaaggagacccatcttgggaaagtgagccttgaaggtgaaggtttggggacagatgatggtctgcactccagggcattacaagagtggttatcagcagatgttctccatgaatgtgactcacagcaaccagggaaagacgccttgattcatgcagggacaaacccctacaaatgcaagcagtgtgggaaaggttttaacaggaagtggtatctcgttcgacatcagagggttcacactggaatgaaaccctatgaatgcaatgcatgtgggaaagcctttagccagagctcaactctcattcggcactacctcatccacaccggggagaaaccatacaagtgccttgagtgtgggaaggccttcaaacgcaggtcgtacctcatgcagcaccatccaatccacactggagagaaaccctatgagtgtagtcaatgtcgaaaggccttcacccaccggtctacttttattcgccataataggacccacactggagaaaagccctttgagtgcaaagaatgtgagaaagcctttagcaatagagcccacctaattcaacattacatcatccacactggagagaagccctatgattgcatggcatgtggaaaggccttcagatgcagctcagaactcatacagcaccagcggattcacactggggagaagccctatgaatgcacccagtgtgggaaagcctttcaccggagcacgtacctcattcagcactctgtcatccacactggggagatgccctacaagtgtatcgagtgtgggaaggccttcaaacgcaggtcacaccttctgcagcaccaaagggtccatacatgagagaaccctattgctgcaatgaatacagcaaggcctttacccactgttattttatcattcataatgggacccacactgtaggaagaagtccttcgagtgcaaagaatgtcaggaaacttttcattttttttgtcagctctttcttaactaacacatgagcagtcactttggagagaagccctgtgaatacagtgaatgtaaggatcccttcagtcaccactcagttctcactcattgcagaaggattcataccagggggaaatgtggaaggcattccatcaacatcagagaactcatgctggagaaagacattccaaatataactattaaggacagtctttggccagagcagaaatcttactatctgagaatcataatgaaaagttactacataattgttattgatgtgagaaaactttgtgaccaggttgtcacttgcttgtcctataaagagccatgctggaatttgacccaccttgggattttctc

SEQ ID NO: 736244 - DNA, 1048 bp, Homo sapiens
tgtcagtgactcagtacttgttatgtgccagacacccttcccaatcattctgatgaatgaatttttcttatctttaaggcctggggaattggcccaatgttacatacctaataagcagtcacatcaggtcataacaacagtagcaaggacttactatgtgccaagtactgtgctttgcaggttacagattatatcataaaaccttcaaccaaaataacatgaggaaagagcttttgttattccattcagagagatgagcaacttgcccaaggccacacagccggtgctaagaggttagtgcctggtgatgaatccacatctctattgtaccaggaacagggcaaggacattgccttgttcatgtctgcaccccattcctgcagagcctacttcattgttggcacatggtaggcacccacatgtgtttgtttagaaaaaaaataggttccttgagatgacaagctgatcaaaggaagacagtaactgtcaaagattgctctgagatgtctgtttcttcatggcatctcctgttccctcagtgccattaggcacaccagtcatgcttgctttcttggcccccagatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggtggggctggggccccagggtgtgtaggacccttctctcactggcagtctgtcctcagcccccagatgggggaagaatgagggggctccgggcccctgggctccaccctgagcacgctcagttcagagatctctcaggttgccgacataggaaatcaggaaagatggtttgccatccagtgcgccagctaccctggaattttgcatggtgaatcatgctaccaa

SEQ ID NO: 736245 - DNA, 586 bp, Homo sapiens
tctagagcggccgcctactactactaaattcgcggccgcgtcgacgcttcatgggggcaatgggattaggaaaatgaggtcaacctgcaaaggaaagcagatgcaagagatggagacagaatgggggtgtcctggggatcttggagcctgaattcattggcacaaaaggcagcagcatcctcactgtatctgcagtccatttggactcaataaaaactttgaaagtcacatgtgttatggaattccttctcagtgacacattcatctgtgctcagttgtcccagcaagggtcagcccctcatacccctgcagcatccgctgctatgaagcagagctgtaaacgccctccctgtgtataggaaaagctacatggagcaaatcctcctgcctgaagaagtgcatctcagcatcacttcagctgtcggggcatttgtggggagaaccagaccacctctgcggaaggcagcagaccctcttccagccatggatggagttgaattctctataaacggttcaccagcaaaccaccaatacattccattgtttgcctagagagaaatttaaaaataaataaatgttcacttat

SEQ ID NO: 736246 - DNA, 1348 bp, Homo sapiens
acaccgcaatttgagagccccactggtataaagtgagtgaaacccaggcagagacaggcaaaatggtgaggcccgcatcctattggtgagtcacacagggaacgctgaaattcatggccttctccaggctactgggaacccatgggcggtgatggagggagtggtgccaccttcacttgctgctgaggctcttccccctctccccagcatactccttacctggctgtctctcctcatgtataaggaacctatagtggtgtagaatctactcttcttccccctgtggcttccaggcccccctgtatagctgctatccagcccgatttctcaccactggcccagggcttcctcctgccccgtggcttcacgtctctgaacacatcaatctctgatgttctctctccttccattgaattccaccagacacattcagggtttacttcgtaatgtcttcatatgagtatcaatcaacaccttccccaactcaattgtactaggttgtagagcacaaggatggtctcgtgctgctctgtggcacctgtgcctacactcctctgagctttgaggaggctgctctctttgctgaccccatgatcttttctgcccttctgttaagggcattggccacagcaacggggcaaatgccccaagctggctgtaagtgacccatccctttggctcccatgattagaccaaggagaggcatggggtccagctgagccattcagaaccattccttagcattttccactcaaaggttagagatgagattttctcttcccaaggctacctctggccatggttccagcttcatgggggcaatgggattaggaaaatgaggtcaacctgcaaaggaaagcagatgcaagagatggagacagaatgggggtgtcctggggatcttggagcctgaattcattggcacaaaaggcagcagcatcctcactgtatctgcagtccatttggactcaataaaaactttgaaagtcacatgtgttatggaattccttctcagtgacacattcatctgtgctcagttgtcccagcaagggtcagcccctcatacccctgcagcatccgctgctatgaagcagagctgtaaacgccctccctgtgtataggaaaagctacatggagcaaatcctcctgcctgaagaagtgcatctcagcatcacttcagctgtcggggcatttgtggggagaaccagaccacctctgcggaaggcagcagaccctcttccagccatggatggagttgaattctctataaacggttcaccagcaaaccaccaatacattccattgtttgcctagagagaaatttaaaaataaataaatgttcacttat

SEQ ID NO: 736247 - DNA, 3552 bp, Homo sapiens
aaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaatcttcctcttgctctctttttctttcctacccctcacttcatctgtttccctgatttttgactctccccttt

SEQ ID NO: 736248 - DNA, 2981 bp, Homo sapiens
aaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaatcttcctcttgctctctttttctttcctacccctcacttcatctgtttccctgatttttgactctccccttt

SEQ ID NO: 736249 - DNA, 1153 bp, Homo sapiens
ttatcgttctgaatgaagtggatcccacatggagcaagagtgagggtgccgtccctacagtagccccctctgttgtgatagcgagttctccttgcccctttctggaggccccctccactgactcagggccttgcttgctttgcccagcagatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaatcttcctcttgctctctttttctttcctacccctcacttcatctgtttccctgatttttgactctccccttt

SEQ ID NO: 736250 - DNA, 1595 bp, Homo sapiens
tagggcaacgcgaccacgcgtcgccacgcgtcggtccaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaatcttcctcttgctctctttttctttcctacccctcacttcatctgtttccctgatttttgactctccccttt

SEQ ID NO: 736251 - DNA, 824 bp, Homo sapiens
ttcttttttagtagagatggggttttaccatgttggccaggctggtcttgaactcattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaatcttcctcttgctctctttttctttcctacccctcacttcatctgtttccctgatttttgactctccccttt

SEQ ID NO: 736252 - DNA, 464 bp, Homo sapiens; identical to SEQ ID NO: 429781

SEQ ID NO: 736253 - DNA, 3753 bp, Homo sapiens
aaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaagactttcctgtcaatgtggccaggcaactcccagcaattcggagcttacacactaccagctcccccaggcgtccagcaaaacagcaagacatctgtatttggacagccacttcttgttctctctgaagaggaccactctgaaccttggatctgttccatcctgcaggaatgcctgtcttagatggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaatcttcctcttgctctctttttctttcctacccctcacttcatctgtttccctgatttttgactctccccttt

SEQ ID NO: 736254 - DNA, 3540 bp, Homo sapiens
aaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaatcttcctcttgctctctttttctttcctacccctcacttcatctgtttccctgatttttgactctccccttt

SEQ ID NO: 736255 - DNA, 1035 bp, Homo sapiens
tgtcagtgactcagtacttgttatgtgccagacacccttcccaatcattctgatgaatgaatttttcttatctttaaggcctggggaattggcccaatgttacatacctaataagcagtcacatcaggtcataacaacagtagcaaggacttactatgtgccaagtactgtgctttgcaggttacagattatatcataaaaccttcaaccaaaataacatgaggaaagagcttttgttattccattcagagagatgagcaacttgcccaaggccacacagccggtgctaagaggttagtgcctggtgatgaatccacatctctattgtaccaggaacagggcaaggacattgccttgttcatgtctgcaccccattcctgcagagcctacttcattgttggcacatggtaggcacccacatgtgtttgtttagaaaaaaaataggttccttgagatgacaagctgatcaaaggaagacagtaactgtcaaagattgctctgagatgtctgtttcttcatggcatctcctgttccctcagtgccattaggcacaccagtcatgcttgctttcttggcccccagatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaaggtgagtggtgggcggtgaggccactgctcccctgggcatggccagacatgggtgtccccagtgtcccagcccaggctctacccttcacttgtcctccgtggcttgagagtggatgtttaga

SEQ ID NO: 736256 - DNA, 2678 bp, Homo sapiens
tgtcagtgactcagtacttgttatgtgccagacacccttcccaatcattctgatgaatgaatttttcttatctttaaggcctggggaattggcccaatgttacatacctaataagcagtcacatcaggtcataacaacagtagcaaggacttactatgtgccaagtactgtgctttgcaggttacagattatatcataaaaccttcaaccaaaataacatgaggaaagagcttttgttattccattcagagagatgagcaacttgcccaaggccacacagccggtgctaagaggttagtgcctggtgatgaatccacatctctattgtaccaggaacagggcaaggacattgccttgttcatgtctgcaccccattcctgcagagcctacttcattgttggcacatggtaggcacccacatgtgtttgtttagaaaaaaaataggttccttgagatgacaagctgatcaaaggaagacagtaactgtcaaagattgctctgagatgtctgtttcttcatggcatctcctgttccctcagtgccattaggcacaccagtcatgcttgctttcttggcccccagatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggtgagctgggaccaggtgtgccaccttcccacaaggccgcacccggatgttggaagggaaagcctctcccagaactggaggtgatcaggcgtcatgagaggagaacaatggggtggaggaagtaggagaagaagacagggaaggagagatctccactaaggggcaggcggctccctttctgcaacttgttcccttccacatctgtgtttcctccttctgtcctttgccctacctaataccacttggctaacgaaaaccttaattcatgattttttacaaatgaagtggagaagaaggtaaaaaactgtggaaggaaaaagattaacctttcttgggcccctactttgttcaaggtccatactggaggctttgtataagaggcagctagaaatcatgggaagagaatcagagggctaggtcagtcatatcacctctctgagctttcaatttttaatgtctaatatgagccttaaaaggttgttatgaggatgggcacggagcctcatgcctataatcccagccctttgggaggctgaggcaggaggatctcttgaggccaggaattcaagacaagcctgggcaacatggtgaggccttgtctctac

SEQ ID NO: 736257 - DNA, 3811 bp, Homo sapiens
tgtcagtgactcagtacttgttatgtgccagacacccttcccaatcattctgatgaatgaatttttcttatctttaaggcctggggaattggcccaatgttacatacctaataagcagtcacatcaggtcataacaacagtagcaaggacttactatgtgccaagtactgtgctttgcaggttacagattatatcataaaaccttcaaccaaaataacatgaggaaagagcttttgttattccattcagagagatgagcaacttgcccaaggccacacagccggtgctaagaggttagtgcctggtgatgaatccacatctctattgtaccaggaacagggcaaggacattgccttgttcatgtctgcaccccattcctgcagagcctacttcattgttggcacatggtaggcacccacatgtgtttgtttagaaaaaaaataggttccttgagatgacaagctgatcaaaggaagacagtaactgtcaaagattgctctgagatgtctgtttcttcatggcatctcctgttccctcagtgccattaggcacaccagtcatgcttgctttcttggcccccagatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaatcttcctcttgctctctttttctttcctacccctcacttcatctgtttccctgatttttgactctccccttt

SEQ ID NO: 736258 - DNA, 3157 bp, Homo sapiens
tgtcagtgactcagtacttgttatgtgccagacacccttcccaatcattctgatgaatgaatttttcttatctttaaggcctggggaattggcccaatgttacatacctaataagcagtcacatcaggtcataacaacagtagcaaggacttactatgtgccaagtactgtgctttgcaggttacagattatatcataaaaccttcaaccaaaataacatgaggaaagagcttttgttattccattcagagagatgagcaacttgcccaaggccacacagccggtgctaagaggttagtgcctggtgatgaatccacatctctattgtaccaggaacagggcaaggacattgccttgttcatgtctgcaccccattcctgcagagcctacttcattgttggcacatggtaggcacccacatgtgtttgtttagaaaaaaaataggttccttgagatgacaagctgatcaaaggaagacagtaactgtcaaagattgctctgagatgtctgtttcttcatggcatctcctgttccctcagtgccattaggcacaccagtcatgcttgctttcttggcccccagatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcaggaaaagctacatggagcaaatcctcctgcctgaagaagtgcatctcagcatcacttcagctgtcggggcatttgtggggagaaccagaccacctctgcggaaggcagcagaccctcttccagccatggatggagttgaattctctataaacggttcaccagcaaaccaccaatacattccattgtttgcctagagagaaatttaaaaataaataaatgttcacttat

SEQ ID NO: 736259 - DNA, 2884 bp, Homo sapiens
tgtcagtgactcagtacttgttatgtgccagacacccttcccaatcattctgatgaatgaatttttcttatctttaaggcctggggaattggcccaatgttacatacctaataagcagtcacatcaggtcataacaacagtagcaaggacttactatgtgccaagtactgtgctttgcaggttacagattatatcataaaaccttcaaccaaaataacatgaggaaagagcttttgttattccattcagagagatgagcaacttgcccaaggccacacagccggtgctaagaggttagtgcctggtgatgaatccacatctctattgtaccaggaacagggcaaggacattgccttgttcatgtctgcaccccattcctgcagagcctacttcattgttggcacatggtaggcacccacatgtgtttgtttagaaaaaaaataggttccttgagatgacaagctgatcaaaggaagacagtaactgtcaaagattgctctgagatgtctgtttcttcatggcatctcctgttccctcagtgccattaggcacaccagtcatgcttgctttcttggcccccagatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggtttgcagaaccagaagaaaccaggagccagaatgtcagaaagaaaaaaggggccaggcgtggtggctcacgcctgtaatcccagcactttgggaggccgaggcaggtggatcacctgaggtcaggagttcgagaccagcctcagcattgagaaactccgtctctactaaaaatacaaaattagctgggcgtggtggtgcatgcctgtaatcccagctactcgggaggctgaggcaggagaattgcttgaacctgggaggcggaggttgcagtgagccgagatcgcgccgttgcactccagctgggcaacaagagtgaaactacatctc

SEQ ID NO: 736260 - DNA, 1291 bp, Homo sapiens
  misc_feature (222)..(222): n is a, c, g, or t
  misc_feature (1257)..(1257): n is a, c, g, or t
cgccttgttctcggagagggtgagttgaaacgctgcctggaaaggaagtaccaggacttgcacaggagttccaccatcttcctctgaagacgtagccatcttgctccatgaaggtcaggacaatctgacatgcacttgtttcttgcctctatacttgaagagtagtcctcttacattgtgtacatttttttcttaataggggaggcgacccccccccccctntccatccctttatagccccctcatccgccatcttgaccgaaatttatgctccctacccacccaccgctcgcgcgttttggccccgccttgcccccccccccccatgaatcgcgtgccgcccctcttccctctcgccacacactctaccgtcacccgcgccttcctctcccctcctgaggacatcggcgccccacatggccccccccgcccccctcgtcttccccctttccccctgacccctcccccctcctccccctaaatataacacccccttcacaccccttacctcctcaccccccgcattatccccccccccctgtccccccccccccttccccccctttatattctccccccttccatcagcccccccccccccccccccccctacccccctattccccccctcctacctccactcctatttctccccgccccccttttcccccaccgttctcattaggtcccgccccccgccactctccgccctcctcccccgcactccgctcactcccctccgccatccatattctgtcgccggcaccacgcgcatagggcaccatccccgtctggtcattatgccctgtcacgaccccccttattatatcctcccctttcccacccctccccatccacacccacaattctcccccaaaaccatcccgaacgtcattccccatccacccctttaccacgcacgatccatacaccccccccctcactctgacgtacccttgttttccccccgcccaccccctattattcccccgtactatccgagattgctctcgcccacgctacaccccttaactatagacgccgccgtctcccacccccttcgatggagcataaccaccctccgcccacctctccctctgtaacactcacccccacccatcgctccccccgctactcctcctcttcttattctcaccaccccctcatttattaaccccccccgcgcccccgtcaactttcttcgtcttgctcactcccaatcgtcgctgtacaccccccatttactaccccgcatcntcccaatctctcgccacgtctacatgcgtatagc

SEQ ID NO: 736261 - DNA, 1344 bp, Homo sapiens
  misc_feature (275)..(275): n is a, c, g, or t
  misc_feature (1310)..(1310): n is a, c, g, or t
tggtgctggagagacagggagaggggcgaaccggccccccacagccactgcagttaccagaaatcttccgcctctgctgtatggaccttactggcaccaaccccggcagtatgagcaggagttccaccatcttcctctgaagacgtagccatcttgctccatgaaggtcaggacaatctgacatgcacttgtttcttgcctctatacttgaagagtagtcctcttacattgtgtacatttttttcttaataggggaggcgacccccccccccctntccatccctttatagccccctcatccgccatcttgaccgaaatttatgctccctacccacccaccgctcgcgcgttttggccccgccttgcccccccccccccatgaatcgcgtgccgcccctcttccctctcgccacacactctaccgtcacccgcgccttcctctcccctcctgaggacatcggcgccccacatggccccccccgcccccctcgtcttccccctttccccctgacccctcccccctcctccccctaaatataacacccccttcacaccccttacctcctcaccccccgcattatccccccccccctgtccccccccccccttccccccctttatattctccccccttccatcagcccccccccccccccccccccctacccccctattccccccctcctacctccactcctatttctccccgccccccttttcccccaccgttctcattaggtcccgccccccgccactctccgccctcctcccccgcactccgctcactcccctccgccatccatattctgtcgccggcaccacgcgcatagggcaccatccccgtctggtcattatgccctgtcacgaccccccttattatatcctcccctttcccacccctccccatccacacccacaattctcccccaaaaccatcccgaacgtcattccccatccacccctttaccacgcacgatccatacaccccccccctcactctgacgtacccttgttttccccccgcccaccccctattattcccccgtactatccgagattgctctcgcccacgctacaccccttaactatagacgccgccgtctcccacccccttcgatggagcataaccaccctccgcccacctctccctctgtaacactcacccccacccatcgctccccccgctactcctcctcttcttattctcaccaccccctcatttattaaccccccccgcgcccccgtcaactttcttcgtcttgctcactcccaatcgtcgctgtacaccccccatttactaccccgcatcntcccaatctctcgccacgtctacatgcgtatagc

SEQ ID NO: 736262 - DNA, 1069 bp, Homo sapiens
ccattgtctctggtaatacagtgttggccgccaaggtccctgggaaccaggctgctgttcagcgcattgtccagcccagccgaccagtaaagcagctggtcctccagccagttaagggttcagctcctgctggaaaccctggggccacagggcccccactgaagcctgcagttacactgacctctacacctacccagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaaggtggtactgcagccacaggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacaccatcactcctgtagtgggtaagaagagaaaacgtaatacctcatctgataattcagatgtggaagtcatgcctgcacagtcacctcgagaagataagaaagcagcatcagg

SEQ ID NO: 736263 - DNA, 1203 bp, Homo sapiens
atctagaggatccggtctccacaggttgcctaaggagggatgaattggcccaggttggaaacggagcaggcagcacttcccttgctgatcagcagtagtgttgtgcctgtgaatagccactgcactctagcctgggcaatacagcgagaccctgtctaaaaataacaaaaaagattgcatcaagacagataggatgatgaacaaagtgagttgtactgtgtcttctgacctgtagtttttatgattctagcatgaagaaaactggtgtaaatatttcagagtataccattctttaatgttgtactcttgcaatttcctttcttcactttagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaaggtggtactgcagccacaggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacaccatcactcctgtagtgggtaagaagagaaaacgtaatacctcatctgataattcagatgtggaagtcatgcctgcacagtcacctcgagaagataagaaagcagcatcagg

SEQ ID NO: 736264 - DNA, 292 bp, Homo sapiens
aaaccctaatatcttctttttttcaaacaccatatttagtagctgtgtgtcctattgactgaagatctaaaaacttctgtctggaagttttgtatgtgatggtttagattaattatgtttttttactcctaaattttctttgctttcactgaaaatgaatttggtttttcctttttagcaccatcactcctgtagtgggtaagaagagaaaacgtaatacctcatctgataattcagatgtggaagtcatgcctgcacagtcacctcgagaagataagaaagcagcatcagg

SEQ ID NO: 736265 - DNA, 985 bp, Homo sapiens
cgccttgttctcggagagggtgagttgaaacgctgcctggaaaggaagtaccaggacttgcacaggagttccaccatcttcctctgaagacgtagccatcttgctccatgaagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaaggtggtactgcagccacaggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacaccatcactcctgtagtgggtaagaagagaaaacgtaatacctcatctgataattcagatgtggaagtcatgcctgcacagtcacctcgagaagataagaaagcagcatcagg

SEQ ID NO: 736266 - DNA, 1647 bp, Homo sapiens
  misc_feature (376)..(376): n is a, c, g, or t
aggacacggagcagtgtgactgtggttctctatgtcagcatcatgcatgctgtgatgaaaactgtatactgaaggcgaaagcagagtgcagtgatggtccatgttgtcataagtgtaaatttcaccgtaagggatatccttgctgtccttctagtcgttcctgtgatctcccagaattttgcaatggtacatctgcattatgccccaacaacaggcataagcaagatggctcaaaatgtcatacaatttacgagtgccttaaagttcattgtatggaccctaataatcagtgcttacaattatatggatatggtgcaaaatcagcctcacaagagtgttacaattcaatgaacagcaaaggggaccaatttggaanctgtggcatttctaccagtcctgggtcacaatatgttcggtgttcagatggtaatatattttgtgggaaacttatatgttcaggtattacaggcttaccaaaaatcaatctccaacatacaatgattcaggtccctcagggagatggctcatgttggagcatggatgcctatatgagtactgacattcctgatgaaggagatgtgcacaatggcacttactgtgcaccaaacaaagtctgcctgaattccgcctgcacagataaaaccccagtgatttctgcctgcaacccagaaaaaacgtgtaatgggaagggagtttgtaatgatttagggcactgccactgtaatgaagggcatgccccccctgactgtgttactgcaggaagtggaggtagtgtggacagtggccctcctggtaagctaggtgggacaccttcaggagaaggtgaaaatcacaatatgactcattccagacgtgaagaacatgctgtagacatgatgatattatcattcattatactttttataatattattattaagtacaattatttgatctgcttgcttaaaaaatcaccagaggctgccccggcagaagctcctccagcagtggctccaccaccggccccagaaataaagccagaagcagcagaagtggccacagaagaaaaagaagagaaggaggaagaaaaagaagaggaggaggaggaagaagaggaggaagaatcagattcctaaggttagaaatagggagatgaagccaagtatatcaaactcctcaagtactgagtgggaatgagatgtttggtgaagtagaaatagatagctttagtggctctgactcagatatactgatgtagaaggaaggattctttcacttttattatttattttggtaattaaatttacattaatttaatatgttaaatattttagtaccttttgctttttcacatttcatttgaaccattaacatgcatctttggacatcaatgtccttgtctttttggcccaattgttttagtcaccagaaactttttcaggacatgctatcttctatttgtttgacatacagaatcatatgtacctgaatttattactaactctgggattttcattttaagtaacaactacctattatgtgaggacagttgtttatgtgattggttgttctaacttgccctataaatgtgcattcatcaaaggagaagtttttaaatccaaaaacaaataaaacccgattcatattagacaactcttcaggttccaca

SEQ ID NO: 736267 - DNA, 963 bp, Homo sapiens; identical to SEQ ID NO: 26359

SEQ ID NO: 736268 - DNA, 850 bp, Homo sapiens
gctgcagagagaacaagacctgagactaattaatgaaggagatgttccacatttaccagttaatagagcatactctgttaatggtgctctgagaagtccaaacatggacatatcttcttccccaaacatcaggcttcgaagacatagtagtcaaattgaaggtgttagacaaatgcataacaatgctcctcggagccagatggccactgaaagagatctcatggcgtggagcagaagagtggtggtcaatgaactaaataatggggttagtagggtacaggaagaatgtcgaactgcaaaaggtgacatagaaatcagtctttatacagttgaaaagaagaaaaagccatcttacactactcaaaggaatgattatgagcctagctgtgggcgttctttacgcaggacacagcgcaaacgtcagcatacttaccaaacacggtccaacatagagcataattcacaggcatcatgtcaaaattcaggtgtacaggaagactcagacagttcttcagaggaagatgaaactgttggcacaagtgacgcttcggtagaggatcctgttgttgaatggcaaagtgaaagttcttccagtgactcatcaagtgaatattctgattggacagcagatgctggaataaatttacaacccccaaaaagacaaaccagacagacaacacgtaaaatatgcagcagctctgatgaggaaaatttgaagtccctagaagaaaggcagaagaaacctaagcagactagaaagaagaaaggaggactggtttctatagcaggtgagcctaatgaagaatggtttgcccctcagtggatcttggatactataccccgacgttcc

SEQ ID NO: 736269 - DNA, 5981 bp, Homo sapiens
attcacaatgaatgtgaaattaaaagcatgatgtagtagtgacccaaaaggaatgtgaattctcctccagaacatgcagagacccatggatgaactgtgtttctagatttttcctccagctttcctgagagaaacaggtcaaaatgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggctttcctggggtttgatgtatgctggcttcatccttatcatggccactttaatggctcttattgtaaaatctgcacaaattgtcgtcctgactggttttgtgatggtcttcaccctctttctcctctatggcctgtctttgataactttagctttcctgatgagtgtgttgataaagaaacctttccttacgggcttggttgtgtttctccttattgtcttttgggggatcctgggattcccagcattgtatacacatcttcctgcatttttggaatggactttgtgtcttcttagcccctttgccttcactgttgggatggcccagcttatacatttggactatgatgtgaattctaatgcccacttggattcttcacaaaatccatacctcataatagctactcttttcatgttggtttttgacacccttctgtatttggtattgacattatattttgacaaaattttgcccgctgaatatggacatcgatgttctcccttgtttttcctgaaatcctgtttttggtttcaacacggaagggctaatcatgtggtccttgagaatgaaacagattctgatcctacacctaatgactgttttgaaccagtgtctccagaattctgtgggaaggaagccatcagaatcaaaaatcttaaaaaagaatatgcagggaagtgtgagagagtagaagctttgaaaggtgtggtgtttgacatatatgaaggccagatcactgccctccttggtcacagtggagctggaaaaactaccctgttaaacatacttagtgggttgtcagttccaacatcaggttcagtcactgtctataatcacacactttcaagaatggctgatatagaaaatatcagcaagttcactggattttgtccacaatccaatgtgcaatttggatttctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagccttgttgagctggaacaagttttgtcttccttccacgaaacaaggaaaacaatcagtggcgtggcgctctggaggcagcaggtctgtgcaatagcaaaagttcgcttcctaaagttaaagaaagaaagaaaaagcctgtggactatattattgctttttggtattagctttatccctcaacttttggaacatctattctacgagtcatatcagaaaagttacccgtgggaactgtctccaaatacatacttcctctcaccaggacaacaaccacaggatcctctgacccatttactggtcatcaataagacagggtcaaccattgataactttttacattcactgaggcgacagaacatagctatagaagtggatgcctttggaactagaaatggcacagatgacccatcttacaatggtgctatcattgtgtcaggtgatgaaaaggatcacagattttcaatagcatgtaatacaaaacggctgaattgctttcctgtcctcctggatgtcattagcaatggactacttggaatttttaattcgtcagaacacattcagactgacagaagcacattttttgaagagcatatggattatgagtatgggtaccgaagtaacaccttcttctggataccgatggcagcctctttcactccatacattgcaatgagcagcattggtgactacaaaaaaaaagctcattcccagctacggatttcaggcctctacccttctgcatactggtttggccaagcactggtggatgtttccctgtactttttgatcctcctgctaatgcaaataatggattatatttttagcccagaggagattatatttataattcaaaacctgttaattcaaatcctgtgtagtattggctatgtctcatctcttgttttcttgacatatgtgatttcattcatttttcgcaatgggagaaaaaatagtggcatttggtcatttttcttcttaattgtggtcatcttctcgatagttgctactgatctaaatgaatatggatttctagggctattttttggcaccatgttaatacctcccttcacattgattggctctctattcattttttctgagatttctcctgattccatggattacttaggagcttcagaatctgaaattgtatacctggcactgctaataccttaccttcattttctcatttttcttttcattctgcgatgcctagaaatgaactgcaggaagaaactaatgagaaaggatcctgtgttcagaatttctccaagaagcaacgctatttttccaaacccagaagagcctgaaggagaggaggaagatatccagatggaaagaatgagaacagtgaatgctatggctgtgcgagactttgatgagacacccgtcatcattgccagctgtctacggaaggaatatgcaggcaaaaagaaaaattgcttttctaaaaggaagaaaacaattgccacaagaaatgtctctttttgtgttaaaaaaggtgaagttataggactgttaggacacaatggagctggtaaaagtacaactattaagatgataactggagacacaaaaccaactgcaggacaggtgattttgaaagggagcggtggaggggaacccctgggcttcctggggtactgccctcaggagaatgcgctgtggcccaacctgacagtgaggcagcacctggaggtgtacgctgccgtgaaaggtctcaggaaaggggacgcaatgatcgccatcacacggttagtggatgcgctcaagctgcaggaccagctgaaggctcccgtgaagaccttgtcagagggaataaagcgaaagctgcgctttgtgctgagcatcctggggaacccgtcagtggtgcttctggatgagccgtcgaccgggatggaccccgaggggcagcagcaaatgtggcaggtgattcgggccacctttagaaacacggagaggggcgccctcctgaccacccactacatggcagaggctgaggcggtgtgtgaccgagtggccatcatggtgtcaggaaggctgagatgtattggttccatccaacacctgaaaagcaaatttggcaaagactacctgctggagatgaagctgaagaacctggcacaaatggagcccctccatgcagagatcctgaggcttttcccccaggctgctcagcaggaaaggttctcctccctgatggtctataagttgcctgttgaggatgtgcgacctttatcacaggctttcttcaaattagagatagttaaacagagtttcgacctggaggagtacagcctctcacagtctaccctggagcaggttttcctggagctctccaaggagcaggagctgggtgatcttgaagaggactttgatccctcggtgaagtggaaactcctcctgcaggaagagccttaaagctccaaataccctatatctttctttaatcctgtgactcttttaaagataatattttatagccttaatatgccttatatcagaggtggtacaaaatgcatttgaaactcatgcaataattatcctcagtagtatttcttacagtgagacaacaggcaatgtcagtgagggcgatcgtagggcataagcctaagccataccatgcagcctttgtgccagcaaccaaatcccatgtttcctactgtgttaagtttaaaaatgcatttattatagaattgtctacatttctgaggatgtcatggagaatgcttaattttctttctctgaacttcaaaatattaaatattttcttatttttttgattaaagtataaattaagacaccctattgacttccgggtaaggggagtcaattgattacccagcagcacagtatttgctttttataattccctttttaaatacttgttcttaattgactggttttccttttctgtcatttttcagagtttagattgtgagtccatgttttgtctgttgtgcctataaaggaaatttgaaatctgtatcattctactataaagacacatgcacacgtatgtttattgcagcactgtttacaatagcaaagacttggaaccaaccaaaatacccacaaatgatagaccggataaagaaaacgtgacacatatacaccatggaatactatgcagccatagaaaaggatgagttcatattcttcacagggacatggatgaagctggaaaccatcatcctcagcaaactaacacaggaacagaaaaccaaacaccgcatgttctcactcataagtgggaattgaacaatgagaatacatggacacagggaggggaacaccacaccctggggcctgttggggggatgggggctaggggagggatagcattaggagaaatacctgatgtagatgatgggttgatgggtg

SEQ ID NO: 736270 - DNA, 266 bp, Homo sapiens
attcacaatgaatgtgaaattaaaagcatgatgtagtagtgacccaaaaggaatgtgaattctcctccagaacatgcagagacccatggatgaactgtgtttctagatttttcctccagctttcctgagagtaagttaacctctaaaattgtggttattttgcatatagaaatataacataagactataaataggcatgccagacgtttaggtagaaaccattaaaagcagtaagttattaacgagtcattttgactttttaaatc

SEQ ID NO: 736271 - DNA, 510 bp, Homo sapiens
acttactgctcattttacagatttctcctgattccatggattacttaggagcttcagaatctgaaattgtatacctggcactgctaatagtaagaagactttttttttcaacattcttgcatgagggaacacaacttttgtatgttttgagtttctctgaattgcatcaaattaagaaggtttggacattttaggcatttgaagcaacacacacatgcacatgcatgcatgcgtgcacacacacacacacacgatggcttttaacctggacccccccccttttttttttttgagacagagtttcactcttgttgcccagactggagtgcaatggcgctatctcagctcaccacaacctccacctcccgtgttcaagcaattctcctgcctcagcctcccaagtagctgggattacaggcatgcaccaccatgtgtggctaattttgtatttttagtagagatggggtttctccatgttggtcaggatggtctcgaacttccgacctcatg

SEQ ID NO: 736272 - DNA, 666 bp, Homo sapiens
tcagccttgtaaaaatgaatgctatcaaatcgaatttttatataatcaaactctttaaatcaattccaatattgaaatcattgcatttatagtgatactaattgtgattgtctttctttttccctagccttaccttcattttctcatttttcttttcattctgcgatgcctagaaatgaactgcaggaagaaactaatgagaaaggatcctgtgttcaggttgagaaaatcaaatcgaatttcatgtttcattttgatattcattctttaaggactttttaatgtgctgaattaattaagtaaaagacacttcacaggatggtttttaaagactgtgatatacaaaattcttataacccataatataggaatatatactgagcttacaatctagagagagaaaccatattagcacacacgagacactggaaaattaaggcagaccataattttactatagaggaaagttatgtgtaagaggtggaatctctaaaataatgggtaaatatagataagcattgggaaagttaatccaatccgggaaggaagaatagtttgtgcaataaaaccaaggatgagatgaaggcaccaggagctcctttgtaggcttatgttgggggatgatgaaaaatgaaagtgaggctagatattggaggatcttgaaac

SEQ ID NO: 736273 - DNA, 235 bp, Homo sapiens; identical to SEQ ID NO: 397085

SEQ ID NO: 736274 - DNA, 485 bp, Homo sapiens
agtaaaagacactcaaatcagcaatcttgagttcaatcacggtcatggaattggtagtaaagtctacactacaatggataaccatggaatgtctgccttttaaagtgggcttttaccaccttttccccaaagttaagtgattactgatttgcatttgtgcacttagcacctgtgtgtgtgaagagaagggcatctctgaagtacggcttacatgcatatacatatacgtgacatttgggatagaatctaagaatgaacttattttgcataggtgattttgaaagggagcggtggaggggaacccctgggcttcctggggtactgccctcaggagaatgcgctgtggcccaacctgacagtgaggcagcacctggaggtgtacgctgccgtgaaaggtctcaggaaaggggacgcaatgatcgccatcacacggtacctgggactggggggcactcccctttgctggaggggatgttgtattaata

SEQ ID NO: 736275 - DNA, 1150 bp, Homo sapiens
atttcggaacgaggtgaaaatgtatatgaaattcaaattttgttgtccataaatacattttattgaaacacagccacacatcactaacatattgtttatgactgtgtttgtgctacaatggcaacagaaactgtacagcctgcaaagctgaaaatattcacaatgtggctatttagaaaaaaagtttgctgaaccctgctccattatctacttttttgtccatattatttatacaataaccttactgaaaaacttgtccagagctgagaaatcagcatagatgtcttcccagaaaagctctctctggaaacctctcccagtgacatccattgtatcatccagctttacttattttgcaatttagttatcaattttcctctctacttgtttattgcctaccttcttttatattatgtgatcctgagggtaggagataagttagctattgcattttcttttcctttacccttgataaatggtgagcttcacaaatcatttgctgaataaatgaatcaaggaagtgatgaagtaacaacattctaactgacggctttgtttctctgctaggctttcctggggtttgatgtatgctggcttcatccttatcatggccactttaatggctcttattgtaaaatctgcacaaattgtcgtcctgactggttttgtgatggtcttcaccctctttctcctctatggcctgtctttggtgagttggttaatttcatctaagtcttttattctctttctctctctctactgccaataatttatcactaattctggtctcacctcttttgttctctttgtagtatttgcatgaaacagtgtctaggggtggaaaaatataaaatatacttttataatataaaattccttttttgtgctactgttctcacagaattatataccagctgaagtctttctcttttctcagataactttagctttcctgatgagtgtgttgataaagaaacctttccttacgggcttggttgtgtttctccttattgtcttttgggggatcctgggattcccagcattgtatacacatcttcctgcatttttggaatggactttgtgtcttcttagcccctttgccctcccttcattgtactttatcattaaaaatcaacttccaaaaaaaaaa

SEQ ID NO: 736276 - DNA, 3441 bp, Homo sapiens
attcacaatgaatgtgaaattaaaagcatgatgtagtagtgacccaaaaggaatgtgaattctcctccagaacatgcagagacccatggatgaactgtgtttctagatttttcctccagctttcctgagagaaacaggtcaaaatgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggctttcctggggtttgatgtatgctggcttcatccttatcatggccactttaatggctcttattgtaaaatctgcacaaattgtcgtcctgactggttttgtgatggtcttcaccctctttctcctctatggcctgtctttgataactttagctttcctgatgagtgtgttgataaagaaacctttccttacgggcttggttgtgtttctccttattgtcttttgggggatcctgggattcccagcattgtatacacatcttcctgcatttttggaatggactttgtgtcttcttagcccctttgccttcactgttgggatggcccagcttatacatttggactatgatgtgaattctaatgcccacttggattcttcacaaaatccatacctcataatagctactcttttcatgttggtttttgacacccttctgtatttggtattgacattatattttgacaaaattttgcccgctgaatatggacatcgatgttctcccttgtttttcctgaaatcctgtttttggtttcaacacggaagggctaatcatgtggtccttgagaatgaaacagattctgatcctacacctaatgactgttttgaaccagtgtctccagaattctgtgggaaggaagccatcagaatcaaaaatcttaaaaaagaatatgcagggaagtgtgagagagtagaagctttgaaaggtgtggtgtttgacatatatgaaggccagatcactgccctccttggtcacagtggagctggaaaaactaccctgttaaacatacttagtgggttgtcagttccaacatcaggttcagtcactgtctataatcacacactttcaagaatggctgatatagaaaatatcagcaagttcactggattttgtccacaatccaatgtgcaatttggatttctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagccttgttgagctggaacaagttttgtcttccttccacgaaacaaggaaaacaatcagtggcgtggcgctctggaggcagcaggtctgtgcaatagcaaaagttcgcttcctaaagttaaagaaagaaagaaaaagcctgtggactatattattgctttttggtattagctttatccctcaacttttggaacatctattctacgagtcatatcagaaaagttacccgtgggaactgtctccaaatacatacttcctctcaccaggacaacaaccacaggatcctctgacccatttactggtcatcaataagacagggtcaaccattgataactttttacattcactgaggcgacagaacatagctatagaagtggatgcctttggaactagaaatggcacagatgacccatcttacaatggtgctatcattgtgtcaggtgatgaaaaggatcacagattttcaatagcatgtaatacaaaacggctgaattgctttcctgtcctcctggatgtcattagcaatggactacttggaatttttaattcgtcagaacacattcagactgacagaagcacattttttgaagagcatatggattatgagtatgggtaccgaagtaacaccttcttctggataccgatggcagcctctttcactccatacattgcaatgagcagcattggtgactacaaagtaagaagagttaaagtcttcacatgttttttatatctagagaacccttcccacacccttacgactataaatttacatgcaagtggtaaatctaatttttgtacttgatgcaatgaataatcaagcactttaataataattgtcaaatatg

SEQ ID NO: 736277 - DNA, 1769 bp, Homo sapiens
  misc_feature (744)..(744): n is a, c, g, or t
gagatagggtctgtctctattgcttaggctggagtgcagtggcacaaccatggcttactgcaaccccaacctcccaggctcaagcaatcctcttgccttagcctcctgagtgactggaactacaggtgcaaatggccatgcctggctaatttttgtattttttatgtagataggctctcactacattgcccaggctggtcttgaactcctgggctcaagcaatcctcctgccttggcctccagaactgttgggattacaagcatgagccaacacacctggccagcatatttttaataaatagcagtctgtgttcccactgcagacaactgaaccagagtttctaaggatggggcaagggcttgggtattttgtaaccatgttgtggttatgcttatatgcagcccaggttgaaaagcatgacgtagttcttgcacatcaaagatttttattttgatttttttctttttgtattcttttcaacattgtattaacatacagtgcacatctaagatttaaagatcttctgagacctgttaccttaaacttttgctccatttagtaaagctccttcttccagccagcttgtttcagaaactacacaaatcatgaattagaacaaaaacatgtatacaaaacctttgattgttagttggatatctttgctatttcattatttactaggcgttgtatggcttttagtgtgctcattttacccttgtgcttatgtctgatcagctatttgncagcagatactcttctagatttgaaatttctttcaatcttttttgtagataagtctagataagtgaagcagtgggaatgcagaaggaacaaagaaatctgtaactggttgtgaggtgtaaacatcactgcactcagaccatagatttgaagtttcttaacctcaaaactctattttagctccaactagtattattttaaaataggtggtttagcaacacatatatccaaaaatggttagattctccagatatccagaatctaaaccatcatcagagtaaaaaggtaagaatatacttcaaagttttctcaagacaatcctggccagaatgcttaagtttgagtagtcaaatacttaacaaaatgaatataaaaaatttagcactagcaactaatcaacaaacatgaatataaatgctttagtatgaagaagccattgatagttgtaataactttgcattgttaattggtatcttacaaattacaacttatgcaaacaaaattatgttggtctataaatattggttaaatgaacatgtttcctgtacatttataaattctccatatgaaaaatactcatctgaaatgctaaaagcaaaaatgttatcagtagaaaagcagctattttatgactttttaaagcaagttatgtctgttatttttcacctgtttcaaaggaatgcataagatgcttttataagtgtttttgttcatgtataacatacttagcacttactacagatgaatgctgtagactacttaatttcaaatgcctacattttcaaaacaatgaagacatattactgaccataaaatggaaatagcaaccattcaaaatagttgaacatttattgtgtcatttactctacggaggcaatctcattattaaagaagttatagccagtttatgtgcatatgtaggtgcaagtatctataatgtacattataatttgtaactatcaaatatgtaagtgtaatgaatatcggtttattttgaatacaagcttatataaaacaaaaaaaaaaa

SEQ ID NO: 736278 - DNA, 10884 bp, Homo sapiens
agccgctgagaggctctgcgtgtgcgtgtgcgcgggtgacgccgtgtgtgtgcgagtgtgtgtgtgtgtgcgcgcgcgcgtgtgagagagagaaagggagagagagagggggactctgtgtgagggaaagaaaacaatttctcctgctctgcagcttctgttcaggatcaatgtgactctaagaacaaatggatgaatgaatatccatatgaagagaaaaacaataaagaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccagaaaacggcgtatccacagatgtgattttgagggatgcaacaaagtgtacacaaaaagttctcacctgaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtgaggaatgctacctgtccagctgagcgtaagagctggatctcttagcggcacccaattcagcagggctgaatccccttcacagtgttaacacaaaagggcatcaccatcccacgatgtctgaaaccagagcaggaaaaagaaggcacacttcttttggtctgaaggtaacccccatcatgactagacgagaaccgtctttacgcgggcctgggagctcagtgacataaatgctgaagagacaggcattgttttccgtgctgtgtcctctgccatttaaagatgtttgtagcttgtacattttctgagctgtcagacattttgttattgataccttaaaggtcacctaccacaaattgatggctagagcaagaccttttaaatttggatgaatctcccatcatcccatcccttaacccctttttacagaaattttagttacaatctgagtaagctagaacacacatccaatctgttaccagcaagcagcatgaaagtagaaacgaagaagcagatggagaggtcccattacctgcaaagaaagggcactcaggcagccctttgcaatcgcgatggcagccactagatatcactctcaacttgtcattctgccatgccctgaagaaaaccaacattgaatctttcatttgtttgtcgttgattgtttttgttttgtttcgattctgttttgttcatctgttcgagcagaggggcagttgaagtctcgtcctggtctctgccctggcatggactggcacagaggtgttctgtagttgaataggaagagcctgtctaaaaaactactgccccacttcaaattgcagtgttctgtcacctaggcatcatctcttcctgcccctagtatttgattacaaggaaccaggggaaaaaaactttcttagacacactggcaccaaggtaagaggtggggctgcccaggcaaagtcagtgaacatgaaaactcagacaaagcagagatggaaataatgcgcctcttgaggagaaaagcaataatgaataaaaggactttcctacaataacttcactgaggactcacgttaccaattttcatacttactaaagggattgtaaaaaacaccccagcattttaggtgtcttggttccatttacagcactgaggtaatctttctgctgtttgttgtcctgcttggttgagtaccacaattaaagattatgctccccttttcttgtttgaaaacagttatttggtgactagaaaggcaagggaggcatagccgggaattaactcttcggttaatgggtcagttctccttggaactgaatcagtggaaagagaatgcttcccatagaaagcccgacatggtgctagtttcctctcttggagagccaaggataagtgactctccaataggttcttctataccgatttcattttctaaactgtatcaggacccaggtgtcctgcattggcatctgcagggatattgaacccactcatcctgtgcagaggatgagaggaaggtgttagttccatcagccccataaaattatgaacctttttgcaactaggaacatatacagtaaacaagcaatacatcaccaacgagcattctttcagaaaaattaccatatttttgtccccaccacaagctgggtttttttccagctttctgtggctgaggggctggtgagattttttgttgttattgttgttgttgctagaattttttatagcttagatataaaaggtctccaacaaagacctttgcaatatattttaattaccaaccacttgatttgggaattgcacatattaccctcacaatattactagcctcatttttaaatgtctggacattctgaaataatttccgggttacagaattaccctttttaggatcatcttctaattcagataatcttattctgatgaagcgagaactatgaacgttgaaacaaggacaatttgtgttggatggtattcaaaaggaattttttaaaacattaagcaacagtgtaatgattttcaggtcaaattatggcttcacaaatatgtgctctatattgtctgccaggtctcaaaaattcatcaagcaatttccctccaacaagggctgcagttctagtgataaatagcatctttagctgcacagtctactactcatcaaccagtgggttttttttagcacctggaaagtttttttgtactatatgcaactcctacttcacattgcctgtgaccattcagaatagaaaaaggtctgttgatgcatgccagtgctggttactagtcagtgacagagaacacagagagggacaaacacagccatgaaccccctggcactagtaccagcacctagttggcaagtagtgggtgcatctctcaagtgaagtgtagatttgtatttagtcctgcttgctctcataaaaagagccagttcttttctctgctgaaagatgtcttgagagtattacaggtagacttggtttttagaattcataaaactgacaggcaggggaatcttcctgagtgacagcttggtttaaatttagcacagaactagatgagttgcacttttctaataacataggatggatttggggaagggaacattttccctcatcctctgaaagtggaaaccagactgagatggtaagttaactgataaaacctgtcagcattccatcattttccccttttgacgtatcagtacttctaagaagggatctaagcacaattaagtgaattgagtccctggtctagcctcaggaactgaaacttctttggggcttgtcttgagacgtggcaaattctccttggtgagttttctaaaagtatttccccatggaaaggagaaagtggtttgggacagaaagaaatggaatgtcttcagtcatggaagagcctccatttcatctcatgtccatttctagcctctttcaaaaagcacagtgcatcatgagcaacagaaaagcagtagaatcctaaaggacataacagttgttccgtaactagaagcattctttgattttaaatttgaagctgttcagtttgcagctggggatatgtgcatggttgggaacttatacacatagagccattaactacttaagcagctgcagtagacctgattttctgtttgcagtatagagattgatttcaagggagttacattatttgaaaagttatgactttcagcctttgaggttttaagaatcccttttcatggtctgatcttaagttgtttgaaaaaagattcacgcttctgcatccacctctgccctcattctgtcaattgtgtgtggactctgagaagcctgcttgataacttgtcttaagttctattaaggcagttagactgagatttctaatgacttcaccataaagattatacttctgcctggcgtcgtttctataaaacactataggacatttgttttcaaaagcagttgagtaacagcaacataaaccacattttttaaaaaaatgagcacttttcattcacttgaaagcttaagtgggaaaaaggaagatgattgtcaggggaaaaacttacaaaatgctacagtgtttacaaatgccagttccaggtgattagaaaggccgttttcattatggttcaaatttggaatagcttatgcaaagattgtgttcatttttatacaattctttttaactttaaattgccatctgtgttttaaacataattctgcactttggaatcagttcattagaatgataacatttatatggataaagatgcagtattccttattctgtacttgatttattatacttaccaaagctgcaactgaataaatctggtgaggtgaggccttcaaaatgtattaatacgcctttgttatgttgttatgactgcttagaaatgtagccatgatgttgttctaaagatgtcttaacatttatagtgaggattgacagaaattaagcagtgttaagaataccagcatccatgttacagtctgcgtataagggactgaatgtgaggtaactcttatgaatcataataggcccagaaagccttaatattcatagttcataatccagtctcagattttgctcttcaatgttgcctgtaaacttagcaggtaaatgtattctagtataaaacatcattgaccaaatctcttcctttagtttttctgaggtagtgcatcccattaaaaaagtctcttcaattagatttggctttagtttagaaaggggtttggtaagtcatgtcttccatatgacatttctactcatccccacactgccttccacttaacctgtacagacagccccaacacatgcacatgtgtgtacacaactgtatatgcagcagccagtgggctaacaaatatcagcaaagaacttttttaaaaagaatttgtaataatccgtgctgtctagaaatgtgagttacttaccttattaggaaaccggcttataatactatatatgactctgcctgcattttatagttaagaaatgtacataaaaattgctatattttcacagtttcattataatgtctgtttagtaacccatgtccactgatactttaaatatgctaattactgagcaattgcaatagaaatccagattttcataagaaaatgaaatagaaggatactgcatctttaaaaaatagagtgaagatattttactgtattcgtaacatatgtgatagtggaaaaagtattttcaaactcacaaattttacagaggttgtaaatagtttgatgaagtatgttgggaaagagagcttctagttttcatcacaataaaaagaaaaaacttgttcagatatgccttgtatatcttacacacaatgagtgaaattgccatgggaactctgtccaactttgtcagagcatgctcttcgtgttctgttcaaaatagagtggccacttgtcatggtttagccaggatggtttaaaatataatgaagtcattttaagttgcagacaactgattccaaactagtaatgtcttttcctgaaaagggcaaaacagctgcacaggattttgcttgtactaaagaggagcatcttacaattgttctcttttctcagttatctccctcctcaacagagtgtgaacaaccatacaggtgtttattcttgttttattccaggagactgcttttaggtataactacatgttgaaagattaagtgctgtgcatatggccacgtgttaaaggaatctatactcgcaataggaataagctaatgcccattttcagaaataaattaaatgctgaaagtgcctgtcagtaaaccttatgaccaatgagatattcctatacttttacacagcaataattcttaataagactgggttttttcctgcacatgtgaacacacacacacatacacacagagagagtaaatacatacacatagtaaatcaaatctgttcacatgcccacaaaaaacgcttttatagctttcaaatatacctaatcttgtttacattaacatttcttaatttgatctttctaacttgcagaacgttaagaacacaaatctgaacattaagtttatcttcagtgaacactattgcatatggtaattataatttccagataaaaagttgactgtcatttgccccaaacttatgaaacagtatgtatgattcaaaaagttttgctcagttaaaaacaccaatttatttggcgcaaaagactgaaggatatttgtttgcttgttcattttatccactcatatcaaacgcacaaattcatctttacatttcttcattcccctttcccctaatatttcctattatcatcttaagaatcattttggaatgaatattgacagaatcatttctccccaaaaagtctgttgaagtaccactgacacttagtaagcctagcctttaaccatctttgcagttagtcctaaaaattaccagatgcacattcagaagctcacaggttttttcctgtaattactgtactgctaaaagtggagtcatggatagaaatatacaatgagactatatgaatagacatgaaccctggaaattctccaaccctgccatctcagagcacaaattcacccaaacaagctactgaggctatcagtaaaattatactcatggagagtcacacatcgggtaagggcaattttaaaagtaggactgtgattaaacattcaggctttagacttccatgatggactcagaccacaggcctcaaaaaaacatccactgttttctcctcccaatgttagaaagaagaaaagggagaaggaaatgtaccaggataagggggtaaaataaccaattaagtgtcaaaggaaagctgctgggttccttaatctcactgaagtcaagtcttctgactgggcttctttccatgtgttgtctgaaaaaactaaagtaccttgaaaggttacacattcagcaaaccatgaagataatagctattctttattaaacactgtgtgccaagcaatagactaggcaatttttagatacgttacctgcaacctgtacaacatttctacactttatggatgggaaacggagacatgggaagtgtggctgagttgttcatggatgtagaaatagtaaacggcaaagtaggaaagtgaaaccgcctatctctgacctggaggtctgcctgtatctttcccactccaccacactgcacgtgggtgtcccgaaaccaccttcccagattcctgactctcagtaattttattatggacaacatgcatgagtagtcatcatatttttcaagtgaaatatcgggacatgatataacacatgacttaacaatggtactgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagttgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcaaaaagtaagatattttagggacataccaacatcttccctttctgctaatttcatgctccaaagatatggcaaaaaaaaaaatcataaaaagtgcttttgccctacttgtgttctagttttcccatggcagaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaactccctaactgactcagacactttggaaatcatagttattaaccattctaattaaacctttgttatgaaaagttttac

SEQ ID NO: 736279 - DNA, 1586 bp, Homo sapiens; identical to SEQ ID NO: 14329

SEQ ID NO: 736280 - DNA, 538 bp, Homo sapiens
gctgcccctactactactccattagcggccgtcgatttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaactccctaactgactcagacactttggaaatcatagttattaaccattctaattaaacctttgttatgaaaagttttac

SEQ ID NO: 736281 - DNA, 1615 bp, Homo sapiens
  misc_feature (41)..(42): n is a, c, g, or t
ccatatctttggagcatgaaattagcagaaagggaagatgnnggtatgtccctaaaatatcataaaaagtgcttttgccctacttgtgttctagttttcccatggcagaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaactccctaactgactcagacactttggaaatcatagttattaaccattctaattaaacctttgttatgaaaagttttac

SEQ ID NO: 736282 - DNA, 10832 bp, Homo sapiens
agccgctgagaggctctgcgtgtgcgtgtgcgcgggtgacgccgtgtgtgtgcgagtgtgtgtgtgtgtgcgcgcgcgcgtgtgagagagagaaagggagagagagagggggactctgtgtgagggaaagaaaacaatttctcctgctctgcagcttctgttcaggatcaatgtgactctaagaacaaatggatgaatgaatatccatatgaagagaaaaacaataaagaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccagaaaacggcgtatccacagatgtgattttgagggatgcaacaaagtgtacacaaaaagttctcacctgaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtgaggaatgctacctgtccagctgagcgtaagagctggatctcttagcggcacccaattcagcagggctgaatccccttcacagtgttaacacaaaagggcatcaccatcccacgatgtctgaaaccagagcaggaaaaagaaggcacacttcttttggtctgaaggtaacccccatcatgactagacgagaaccgtctttacgcgggcctgggagctcagtgacataaatgctgaagagacaggcattgttttccgtgctgtgtcctctgccatttaaagatgtttgtagcttgtacattttctgagctgtcagacattttgttattgataccttaaaggtcacctaccacaaattgatggctagagcaagaccttttaaatttggatgaatctcccatcatcccatcccttaacccctttttacagaaattttagttacaatctgagtaagctagaacacacatccaatctgttaccagcaagcagcatgaaagtagaaacgaagaagcagatggagaggtcccattacctgcaaagaaagggcactcaggcagccctttgcaatcgcgatggcagccactagatatcactctcaacttgtcattctgccatgccctgaagaaaaccaacattgaatctttcatttgtttgtcgttgattgtttttgttttgtttcgattctgttttgttcatctgttcgagcagaggggcagttgaagtctcgtcctggtctctgccctggcatggactggcacagaggtgttctgtagttgaataggaagagcctgtctaaaaaactactgccccacttcaaattgcagtgttctgtcacctaggcatcatctcttcctgcccctagtatttgattacaaggaaccaggggaaaaaaactttcttagacacactggcaccaaggtaagaggtggggctgcccaggcaaagtcagtgaacatgaaaactcagacaaagcagagatggaaataatgcgcctcttgaggagaaaagcaataatgaataaaaggactttcctacaataacttcactgaggactcacgttaccaattttcatacttactaaagggattgtaaaaaacaccccagcattttaggtgtcttggttccatttacagcactgaggtaatctttctgctgtttgttgtcctgcttggttgagtaccacaattaaagattatgctccccttttcttgtttgaaaacagttatttggtgactagaaaggcaagggaggcatagccgggaattaactcttcggttaatgggtcagttctccttggaactgaatcagtggaaagagaatgcttcccatagaaagcccgacatggtgctagtttcctctcttggagagccaaggataagtgactctccaataggttcttctataccgatttcattttctaaactgtatcaggacccaggtgtcctgcattggcatctgcagggatattgaacccactcatcctgtgcagaggatgagaggaaggtgttagttccatcagccccataaaattatgaacctttttgcaactaggaacatatacagtaaacaagcaatacatcaccaacgagcattctttcagaaaaattaccatatttttgtccccaccacaagctgggtttttttccagctttctgtggctgaggggctggtgagattttttgttgttattgttgttgttgctagaattttttatagcttagatataaaaggtctccaacaaagacctttgcaatatattttaattaccaaccacttgatttgggaattgcacatattaccctcacaatattactagcctcatttttaaatgtctggacattctgaaataatttccgggttacagaattaccctttttaggatcatcttctaattcagataatcttattctgatgaagcgagaactatgaacgttgaaacaaggacaatttgtgttggatggtattcaaaaggaattttttaaaacattaagcaacagtgtaatgattttcaggtcaaattatggcttcacaaatatgtgctctatattgtctgccaggtctcaaaaattcatcaagcaatttccctccaacaagggctgcagttctagtgataaatagcatctttagctgcacagtctactactcatcaaccagtgggttttttttagcacctggaaagtttttttgtactatatgcaactcctacttcacattgcctgtgaccattcagaatagaaaaaggtctgttgatgcatgccagtgctggttactagtcagtgacagagaacacagagagggacaaacacagccatgaaccccctggcactagtaccagcacctagttggcaagtagtgggtgcatctctcaagtgaagtgtagatttgtatttagtcctgcttgctctcataaaaagagccagttcttttctctgctgaaagatgtcttgagagtattacaggtagacttggtttttagaattcataaaactgacaggcaggggaatcttcctgagtgacagcttggtttaaatttagcacagaactagatgagttgcacttttctaataacataggatggatttggggaagggaacattttccctcatcctctgaaagtggaaaccagactgagatggtaagttaactgataaaacctgtcagcattccatcattttccccttttgacgtatcagtacttctaagaagggatctaagcacaattaagtgaattgagtccctggtctagcctcaggaactgaaacttctttggggcttgtcttgagacgtggcaaattctccttggtgagttttctaaaagtatttccccatggaaaggagaaagtggtttgggacagaaagaaatggaatgtcttcagtcatggaagagcctccatttcatctcatgtccatttctagcctctttcaaaaagcacagtgcatcatgagcaacagaaaagcagtagaatcctaaaggacataacagttgttccgtaactagaagcattctttgattttaaatttgaagctgttcagtttgcagctggggatatgtgcatggttgggaacttatacacatagagccattaactacttaagcagctgcagtagacctgattttctgtttgcagtatagagattgatttcaagggagttacattatttgaaaagttatgactttcagcctttgaggttttaagaatcccttttcatggtctgatcttaagttgtttgaaaaaagattcacgcttctgcatccacctctgccctcattctgtcaattgtgtgtggactctgagaagcctgcttgataacttgtcttaagttctattaaggcagttagactgagatttctaatgacttcaccataaagattatacttctgcctggcgtcgtttctataaaacactataggacatttgttttcaaaagcagttgagtaacagcaacataaaccacattttttaaaaaaatgagcacttttcattcacttgaaagcttaagtgggaaaaaggaagatgattgtcaggggaaaaacttacaaaatgctacagtgtttacaaatgccagttccaggtgattagaaaggccgttttcattatggttcaaatttggaatagcttatgcaaagattgtgttcatttttatacaattctttttaactttaaattgccatctgtgttttaaacataattctgcactttggaatcagttcattagaatgataacatttatatggataaagatgcagtattccttattctgtacttgatttattatacttaccaaagctgcaactgaataaatctggtgaggtgaggccttcaaaatgtattaatacgcctttgttatgttgttatgactgcttagaaatgtagccatgatgttgttctaaagatgtcttaacatttatagtgaggattgacagaaattaagcagtgttaagaataccagcatccatgttacagtctgcgtataagggactgaatgtgaggtaactcttatgaatcataataggcccagaaagccttaatattcatagttcataatccagtctcagattttgctcttcaatgttgcctgtaaacttagcaggtaaatgtattctagtataaaacatcattgaccaaatctcttcctttagtttttctgaggtagtgcatcccattaaaaaagtctcttcaattagatttggctttagtttagaaaggggtttggtaagtcatgtcttccatatgacatttctactcatccccacactgccttccacttaacctgtacagacagccccaacacatgcacatgtgtgtacacaactgtatatgcagcagccagtgggctaacaaatatcagcaaagaacttttttaaaaagaatttgtaataatccgtgctgtctagaaatgtgagttacttaccttattaggaaaccggcttataatactatatatgactctgcctgcattttatagttaagaaatgtacataaaaattgctatattttcacagtttcattataatgtctgtttagtaacccatgtccactgatactttaaatatgctaattactgagcaattgcaatagaaatccagattttcataagaaaatgaaatagaaggatactgcatctttaaaaaatagagtgaagatattttactgtattcgtaacatatgtgatagtggaaaaagtattttcaaactcacaaattttacagaggttgtaaatagtttgatgaagtatgttgggaaagagagcttctagttttcatcacaataaaaagaaaaaacttgttcagatatgccttgtatatcttacacacaatgagtgaaattgccatgggaactctgtccaactttgtcagagcatgctcttcgtgttctgttcaaaatagagtggccacttgtcatggtttagccaggatggtttaaaatataatgaagtcattttaagttgcagacaactgattccaaactagtaatgtcttttcctgaaaagggcaaaacagctgcacaggattttgcttgtactaaagaggagcatcttacaattgttctcttttctcagttatctccctcctcaacagagtgtgaacaaccatacaggtgtttattcttgttttattccaggagactgcttttaggtataactacatgttgaaagattaagtgctgtgcatatggccacgtgttaaaggaatctatactcgcaataggaataagctaatgcccattttcagaaataaattaaatgctgaaagtgcctgtcagtaaaccttatgaccaatgagatattcctatacttttacacagcaataattcttaataagactgggttttttcctgcacatgtgaacacacacacacatacacacagagagagtaaatacatacacatagtaaatcaaatctgttcacatgcccacaaaaaacgcttttatagctttcaaatatacctaatcttgtttacattaacatttcttaatttgatctttctaacttgcagaacgttaagaacacaaatctgaacattaagtttatcttcagtgaacactattgcatatggtaattataatttccagataaaaagttgactgtcatttgccccaaacttatgaaacagtatgtatgattcaaaaagttttgctcagttaaaaacaccaatttatttggcgcaaaagactgaaggatatttgtttgcttgttcattttatccactcatatcaaacgcacaaattcatctttacatttcttcattcccctttcccctaatatttcctattatcatcttaagaatcattttggaatgaatattgacagaatcatttctccccaaaaagtctgttgaagtaccactgacacttagtaagcctagcctttaaccatctttgcagttagtcctaaaaattaccagatgcacattcagaagctcacaggttttttcctgtaattactgtactgctaaaagtggagtcatggatagaaatatacaatgagactatatgaatagacatgaaccctggaaattctccaaccctgccatctcagagcacaaattcacccaaacaagctactgaggctatcagtaaaattatactcatggagagtcacacatcgggtaagggcaattttaaaagtaggactgtgattaaacattcaggctttagacttccatgatggactcagaccacaggcctcaaaaaaacatccactgttttctcctcccaatgttagaaagaagaaaagggagaaggaaatgtaccaggataagggggtaaaataaccaattaagtgtcaaaggaaagctgctgggttccttaatctcactgaagtcaagtcttctgactgggcttctttccatgtgttgtctgaaaaaactaaagtaccttgaaaggttacacattcagcaaaccatgaagataatagctattctttattaaacactgtgtgccaagcaatagactaggcaatttttagatacgttacctgcaacctgtacaacatttctacactttatggatgggaaacggagacatgggaagtgtggctgagttgttcatggatgtagaaatagtaaacggcaaagtaggaaagtgaaaccgcctatctctgacctggaggtctgcctgtatctttcccactccaccacactgcacgtgggtgtcccgaaaccaccttcccagattcctgactctcagtaattttattatggacaacatgcatgagtagtcatcatatttttcaagtgaaatatcgggacatgatataacacatgacttaacaatggtactgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagttgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcaaaaagtaagatattttagggacataccaacatcttccctttctgctaatttcatgctccaaagatatggcaaaaaaaaaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaactccctaactgactcagacactttggaaatcatagttattaaccattctaattaaacctttgttatgaaaagttttac

SEQ ID NO: 736283 - DNA, 10928 bp, Homo sapiens
  misc_feature (9015)..(9015): n is a, c, g, or t
agccgctgagaggctctgcgtgtgcgtgtgcgcgggtgacgccgtgtgtgtgcgagtgtgtgtgtgtgtgcgcgcgcgcgtgtgagagagagaaagggagagagagagggggactctgtgtgagggaaagaaaacaatttctcctgctctgcagcttctgttcaggatcaatgtgactctaagaacaaatggatgaatgaatatccatatgaagagaaaaacaataaagaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccagaaaacggcgtatccacagatgtgattttgagggatgcaacaaagtgtacacaaaaagttctcacctgaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtgaggaatgctacctgtccagctgagcgtaagagctggatctcttagcggcacccaattcagcagggctgaatccccttcacagtgttaacacaaaagggcatcaccatcccacgatgtctgaaaccagagcaggaaaaagaaggcacacttcttttggtctgaaggtaacccccatcatgactagacgagaaccgtctttacgcgggcctgggagctcagtgacataaatgctgaagagacaggcattgttttccgtgctgtgtcctctgccatttaaagatgtttgtagcttgtacattttctgagctgtcagacattttgttattgataccttaaaggtcacctaccacaaattgatggctagagcaagaccttttaaatttggatgaatctcccatcatcccatcccttaacccctttttacagaaattttagttacaatctgagtaagctagaacacacatccaatctgttaccagcaagcagcatgaaagtagaaacgaagaagcagatggagaggtcccattacctgcaaagaaagggcactcaggcagccctttgcaatcgcgatggcagccactagatatcactctcaacttgtcattctgccatgccctgaagaaaaccaacattgaatctttcatttgtttgtcgttgattgtttttgttttgtttcgattctgttttgttcatctgttcgagcagaggggcagttgaagtctcgtcctggtctctgccctggcatggactggcacagaggtgttctgtagttgaataggaagagcctgtctaaaaaactactgccccacttcaaattgcagtgttctgtcacctaggcatcatctcttcctgcccctagtatttgattacaaggaaccaggggaaaaaaactttcttagacacactggcaccaaggtaagaggtggggctgcccaggcaaagtcagtgaacatgaaaactcagacaaagcagagatggaaataatgcgcctcttgaggagaaaagcaataatgaataaaaggactttcctacaataacttcactgaggactcacgttaccaattttcatacttactaaagggattgtaaaaaacaccccagcattttaggtgtcttggttccatttacagcactgaggtaatctttctgctgtttgttgtcctgcttggttgagtaccacaattaaagattatgctccccttttcttgtttgaaaacagttatttggtgactagaaaggcaagggaggcatagccgggaattaactcttcggttaatgggtcagttctccttggaactgaatcagtggaaagagaatgcttcccatagaaagcccgacatggtgctagtttcctctcttggagagccaaggataagtgactctccaataggttcttctataccgatttcattttctaaactgtatcaggacccaggtgtcctgcattggcatctgcagggatattgaacccactcatcctgtgcagaggatgagaggaaggtgttagttccatcagccccataaaattatgaacctttttgcaactaggaacatatacagtaaacaagcaatacatcaccaacgagcattctttcagaaaaattaccatatttttgtccccaccacaagctgggtttttttccagctttctgtggctgaggggctggtgagattttttgttgttattgttgttgttgctagaattttttatagcttagatataaaaggtctccaacaaagacctttgcaatatattttaattaccaaccacttgatttgggaattgcacatattaccctcacaatattactagcctcatttttaaatgtctggacattctgaaataatttccgggttacagaattaccctttttaggatcatcttctaattcagataatcttattctgatgaagcgagaactatgaacgttgaaacaaggacaatttgtgttggatggtattcaaaaggaattttttaaaacattaagcaacagtgtaatgattttcaggtcaaattatggcttcacaaatatgtgctctatattgtctgccaggtctcaaaaattcatcaagcaatttccctccaacaagggctgcagttctagtgataaatagcatctttagctgcacagtctactactcatcaaccagtgggttttttttagcacctggaaagtttttttgtactatatgcaactcctacttcacattgcctgtgaccattcagaatagaaaaaggtctgttgatgcatgccagtgctggttactagtcagtgacagagaacacagagagggacaaacacagccatgaaccccctggcactagtaccagcacctagttggcaagtagtgggtgcatctctcaagtgaagtgtagatttgtatttagtcctgcttgctctcataaaaagagccagttcttttctctgctgaaagatgtcttgagagtattacaggtagacttggtttttagaattcataaaactgacaggcaggggaatcttcctgagtgacagcttggtttaaatttagcacagaactagatgagttgcacttttctaataacataggatggatttggggaagggaacattttccctcatcctctgaaagtggaaaccagactgagatggtaagttaactgataaaacctgtcagcattccatcattttccccttttgacgtatcagtacttctaagaagggatctaagcacaattaagtgaattgagtccctggtctagcctcaggaactgaaacttctttggggcttgtcttgagacgtggcaaattctccttggtgagttttctaaaagtatttccccatggaaaggagaaagtggtttgggacagaaagaaatggaatgtcttcagtcatggaagagcctccatttcatctcatgtccatttctagcctctttcaaaaagcacagtgcatcatgagcaacagaaaagcagtagaatcctaaaggacataacagttgttccgtaactagaagcattctttgattttaaatttgaagctgttcagtttgcagctggggatatgtgcatggttgggaacttatacacatagagccattaactacttaagcagctgcagtagacctgattttctgtttgcagtatagagattgatttcaagggagttacattatttgaaaagttatgactttcagcctttgaggttttaagaatcccttttcatggtctgatcttaagttgtttgaaaaaagattcacgcttctgcatccacctctgccctcattctgtcaattgtgtgtggactctgagaagcctgcttgataacttgtcttaagttctattaaggcagttagactgagatttctaatgacttcaccataaagattatacttctgcctggcgtcgtttctataaaacactataggacatttgttttcaaaagcagttgagtaacagcaacataaaccacattttttaaaaaaatgagcacttttcattcacttgaaagcttaagtgggaaaaaggaagatgattgtcaggggaaaaacttacaaaatgctacagtgtttacaaatgccagttccaggtgattagaaaggccgttttcattatggttcaaatttggaatagcttatgcaaagattgtgttcatttttatacaattctttttaactttaaattgccatctgtgttttaaacataattctgcactttggaatcagttcattagaatgataacatttatatggataaagatgcagtattccttattctgtacttgatttattatacttaccaaagctgcaactgaataaatctggtgaggtgaggccttcaaaatgtattaatacgcctttgttatgttgttatgactgcttagaaatgtagccatgatgttgttctaaagatgtcttaacatttatagtgaggattgacagaaattaagcagtgttaagaataccagcatccatgttacagtctgcgtataagggactgaatgtgaggtaactcttatgaatcataataggcccagaaagccttaatattcatagttcataatccagtctcagattttgctcttcaatgttgcctgtaaacttagcaggtaaatgtattctagtataaaacatcattgaccaaatctcttcctttagtttttctgaggtagtgcatcccattaaaaaagtctcttcaattagatttggctttagtttagaaaggggtttggtaagtcatgtcttccatatgacatttctactcatccccacactgccttccacttaacctgtacagacagccccaacacatgcacatgtgtgtacacaactgtatatgcagcagccagtgggctaacaaatatcagcaaagaacttttttaaaaagaatttgtaataatccgtgctgtctagaaatgtgagttacttaccttattaggaaaccggcttataatactatatatgactctgcctgcattttatagttaagaaatgtacataaaaattgctatattttcacagtttcattataatgtctgtttagtaacccatgtccactgatactttaaatatgctaattactgagcaattgcaatagaaatccagattttcataagaaaatgaaatagaaggatactgcatctttaaaaaatagagtgaagatattttactgtattcgtaacatatgtgatagtggaaaaagtattttcaaactcacaaattttacagaggttgtaaatagtttgatgaagtatgttgggaaagagagcttctagttttcatcacaataaaaagaaaaaacttgttcagatatgccttgtatatcttacacacaatgagtgaaattgccatgggaactctgtccaactttgtcagagcatgctcttcgtgttctgttcaaaatagagtggccacttgtcatggtttagccaggatggtttaaaatataatgaagtcattttaagttgcagacaactgattccaaactagtaatgtcttttcctgaaaagggcaaaacagctgcacaggattttgcttgtactaaagaggagcatcttacaattgttctcttttctcagttatctccctcctcaacagagtgtgaacaaccatacaggtgtttattcttgttttattccaggagactgcttttaggtataactacatgttgaaagattaagtgctgtgcatatggccacgtgttaaaggaatctatactcgcaataggaataagctaatgcccattttcagaaataaattaaatgctgaaagtgcctgtcagtaaaccttatgaccaatgagatattcctatacttttacacagcaataattcttaataagactgggttttttcctgcacatgtgaacacacacacacatacacacagagagagtaaatacatacacatagtaaatcaaatctgttcacatgcccacaaaaaacgcttttatagctttcaaatatacctaatcttgtttacattaacatttcttaatttgatctttctaacttgcagaacgttaagaacacaaatctgaacattaagtttatcttcagtgaacactattgcatatggtaattataatttccagataaaaagttgactgtcatttgccccaaacttatgaaacagtatgtatgattcaaaaagttttgctcagttaaaaacaccaatttatttggcgcaaaagactgaaggatatttgtttgcttgttcattttatccactcatatcaaacgcacaaattcatctttacatttcttcattcccctttcccctaatatttcctattatcatcttaagaatcattttggaatgaatattgacagaatcatttctccccaaaaagtctgttgaagtaccactgacacttagtaagcctagcctttaaccatctttgcagttagtcctaaaaattaccagatgcacattcagaagctcacaggttttttcctgtaattactgtactgctaaaagtggagtcatggatagaaatatacaatgagactatatgaatagacatgaaccctggaaattctccaaccctgccatctcagagcacaaattcacccaaacaagctactgaggctatcagtaaaattatactcatggagagtcacacatcgggtaagggcaattttaaaagtaggactgtgattaaacattcaggctttagacttccatgatggactcagaccacaggcctcaaaaaaacatccactgttttctcctcccaatgttagaaagaagaaaagggagaaggaaatgtaccaggataagggggtaaaataaccaattaagtgtcaaaggaaagctgctgggttccttaatctcactgaagtcaagtcttctgactgggcttctttccatgtgttgtctgaaaaaactaaagtaccttgaaaggttacacattcagcaaaccatgaagataatagctattctttattaaacactgtgtgccaagcaatagactaggcaatttttagatacgttacctgcaacctgtacaacatttctacactttatggatgggaaacggagacatgggaagtgtggctgagttgttcatggatgtagaaatagtaaacggcaaagtaggaaagtgaaaccgcctatctctgacctggaggtctgcctgtatctttcccactccaccacactgcacgtgggtgtcccgaaaccaccttcccagattcctgactctcagtaattttattatggacaacatgcatgagtagtcatcatatttttcaagtgaaatatcgggacatgatataacacatgacttaacaatggtactgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagaaagggggtttcttgggaaaaaaaaaaggcaagnatcccaacaattgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcaaaaagtaagatattttagggacataccaacatcttccctttctgctaatttcatgctccaaagatatggcaaaaaaaaaaatcataaaaagtgcttttgccctacttgtgttctagttttcccatggcagaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaactccctaactgactcagacactttggaaatcatagttattaaccattctaattaaacctttgttatgaaaagttttac

SEQ ID NO: 736284 - DNA, 3477 bp, Homo sapiens
taaatggtggctgctttaggcctactatgggtgtaaatttcttactctccaaacaagctactgaggctatcagtaaaattatactcatggagagtcacacatcgggtaagggcaattttaaaagtaggactgtgattaaacattcaggctttagacttccatgatggactcagaccacaggcctcaaaaaaacatccactgttttctcctcccaatgttagaaagaagaaaagggagaaggaaatgtaccaggataagggggtaaaataaccaattaagtgtcaaaggaaagctgctgggttccttaatctcactgaagtcaagtcttctgactgggcttctttccatgtgttgtctgaaaaaactaaagtaccttgaaaggttacacattcagcaaaccatgaagataatagctattctttattaaacactgtgtgccaagcaatagactaggcaatttttagatacgttacctgcaacctgtacaacatttctacactttatggatgggaaacggagacatgggaagtgtggctgagttgttcatggatgtagaaatagtaaacggcaaagtaggaaagtgaaaccgcctatctctgacctggaggtctgcctgtatctttcccactccaccacactgcacgtgggtgtcccgaaaccaccttcccagattcctgactctcagtaattttattatggacaacatgcatgagtagtcatcatatttttcaagtgaaatatcgggacatgatataacacatgacttaacaatggtactgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagttgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcaaaaagtaagatattttagggacataccaacatcttccctttctgctaatttcatgctccaaagatatggcaaaaaaaaaaatcataaaaagtgcttttgccctacttgtgttctagttttcccatggcagaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaactccctaactgactcagacactttggaaatcatagttattaaccattctaattaaacctttgttatgaaaagttttac

SEQ ID NO: 736285 - DNA, 10688 bp, Homo sapiens
tatggagtctccctctgttgcccaagctggagagcagtggcatgatcttggctcactgcagcctccacctcctgggttcaagcgattcttctgcctcaccttcctgagtagctcggattacagtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccagaaaacggcgtatccacagatgtgattttgagggatgcaacaaagtgtacacaaaaagttctcacctgaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtgaggaatgctacctgtccagctgagcgtaagagctggatctcttagcggcacccaattcagcagggctgaatccccttcacagtgttaacacaaaagggcatcaccatcccacgatgtctgaaaccagagcaggaaaaagaaggcacacttcttttggtctgaaggtaacccccatcatgactagacgagaaccgtctttacgcgggcctgggagctcagtgacataaatgctgaagagacaggcattgttttccgtgctgtgtcctctgccatttaaagatgtttgtagcttgtacattttctgagctgtcagacattttgttattgataccttaaaggtcacctaccacaaattgatggctagagcaagaccttttaaatttggatgaatctcccatcatcccatcccttaacccctttttacagaaattttagttacaatctgagtaagctagaacacacatccaatctgttaccagcaagcagcatgaaagtagaaacgaagaagcagatggagaggtcccattacctgcaaagaaagggcactcaggcagccctttgcaatcgcgatggcagccactagatatcactctcaacttgtcattctgccatgccctgaagaaaaccaacattgaatctttcatttgtttgtcgttgattgtttttgttttgtttcgattctgttttgttcatctgttcgagcagaggggcagttgaagtctcgtcctggtctctgccctggcatggactggcacagaggtgttctgtagttgaataggaagagcctgtctaaaaaactactgccccacttcaaattgcagtgttctgtcacctaggcatcatctcttcctgcccctagtatttgattacaaggaaccaggggaaaaaaactttcttagacacactggcaccaaggtaagaggtggggctgcccaggcaaagtcagtgaacatgaaaactcagacaaagcagagatggaaataatgcgcctcttgaggagaaaagcaataatgaataaaaggactttcctacaataacttcactgaggactcacgttaccaattttcatacttactaaagggattgtaaaaaacaccccagcattttaggtgtcttggttccatttacagcactgaggtaatctttctgctgtttgttgtcctgcttggttgagtaccacaattaaagattatgctccccttttcttgtttgaaaacagttatttggtgactagaaaggcaagggaggcatagccgggaattaactcttcggttaatgggtcagttctccttggaactgaatcagtggaaagagaatgcttcccatagaaagcccgacatggtgctagtttcctctcttggagagccaaggataagtgactctccaataggttcttctataccgatttcattttctaaactgtatcaggacccaggtgtcctgcattggcatctgcagggatattgaacccactcatcctgtgcagaggatgagaggaaggtgttagttccatcagccccataaaattatgaacctttttgcaactaggaacatatacagtaaacaagcaatacatcaccaacgagcattctttcagaaaaattaccatatttttgtccccaccacaagctgggtttttttccagctttctgtggctgaggggctggtgagattttttgttgttattgttgttgttgctagaattttttatagcttagatataaaaggtctccaacaaagacctttgcaatatattttaattaccaaccacttgatttgggaattgcacatattaccctcacaatattactagcctcatttttaaatgtctggacattctgaaataatttccgggttacagaattaccctttttaggatcatcttctaattcagataatcttattctgatgaagcgagaactatgaacgttgaaacaaggacaatttgtgttggatggtattcaaaaggaattttttaaaacattaagcaacagtgtaatgattttcaggtcaaattatggcttcacaaatatgtgctctatattgtctgccaggtctcaaaaattcatcaagcaatttccctccaacaagggctgcagttctagtgataaatagcatctttagctgcacagtctactactcatcaaccagtgggttttttttagcacctggaaagtttttttgtactatatgcaactcctacttcacattgcctgtgaccattcagaatagaaaaaggtctgttgatgcatgccagtgctggttactagtcagtgacagagaacacagagagggacaaacacagccatgaaccccctggcactagtaccagcacctagttggcaagtagtgggtgcatctctcaagtgaagtgtagatttgtatttagtcctgcttgctctcataaaaagagccagttcttttctctgctgaaagatgtcttgagagtattacaggtagacttggtttttagaattcataaaactgacaggcaggggaatcttcctgagtgacagcttggtttaaatttagcacagaactagatgagttgcacttttctaataacataggatggatttggggaagggaacattttccctcatcctctgaaagtggaaaccagactgagatggtaagttaactgataaaacctgtcagcattccatcattttccccttttgacgtatcagtacttctaagaagggatctaagcacaattaagtgaattgagtccctggtctagcctcaggaactgaaacttctttggggcttgtcttgagacgtggcaaattctccttggtgagttttctaaaagtatttccccatggaaaggagaaagtggtttgggacagaaagaaatggaatgtcttcagtcatggaagagcctccatttcatctcatgtccatttctagcctctttcaaaaagcacagtgcatcatgagcaacagaaaagcagtagaatcctaaaggacataacagttgttccgtaactagaagcattctttgattttaaatttgaagctgttcagtttgcagctggggatatgtgcatggttgggaacttatacacatagagccattaactacttaagcagctgcagtagacctgattttctgtttgcagtatagagattgatttcaagggagttacattatttgaaaagttatgactttcagcctttgaggttttaagaatcccttttcatggtctgatcttaagttgtttgaaaaaagattcacgcttctgcatccacctctgccctcattctgtcaattgtgtgtggactctgagaagcctgcttgataacttgtcttaagttctattaaggcagttagactgagatttctaatgacttcaccataaagattatacttctgcctggcgtcgtttctataaaacactataggacatttgttttcaaaagcagttgagtaacagcaacataaaccacattttttaaaaaaatgagcacttttcattcacttgaaagcttaagtgggaaaaaggaagatgattgtcaggggaaaaacttacaaaatgctacagtgtttacaaatgccagttccaggtgattagaaaggccgttttcattatggttcaaatttggaatagcttatgcaaagattgtgttcatttttatacaattctttttaactttaaattgccatctgtgttttaaacataattctgcactttggaatcagttcattagaatgataacatttatatggataaagatgcagtattccttattctgtacttgatttattatacttaccaaagctgcaactgaataaatctggtgaggtgaggccttcaaaatgtattaatacgcctttgttatgttgttatgactgcttagaaatgtagccatgatgttgttctaaagatgtcttaacatttatagtgaggattgacagaaattaagcagtgttaagaataccagcatccatgttacagtctgcgtataagggactgaatgtgaggtaactcttatgaatcataataggcccagaaagccttaatattcatagttcataatccagtctcagattttgctcttcaatgttgcctgtaaacttagcaggtaaatgtattctagtataaaacatcattgaccaaatctcttcctttagtttttctgaggtagtgcatcccattaaaaaagtctcttcaattagatttggctttagtttagaaaggggtttggtaagtcatgtcttccatatgacatttctactcatccccacactgccttccacttaacctgtacagacagccccaacacatgcacatgtgtgtacacaactgtatatgcagcagccagtgggctaacaaatatcagcaaagaacttttttaaaaagaatttgtaataatccgtgctgtctagaaatgtgagttacttaccttattaggaaaccggcttataatactatatatgactctgcctgcattttatagttaagaaatgtacataaaaattgctatattttcacagtttcattataatgtctgtttagtaacccatgtccactgatactttaaatatgctaattactgagcaattgcaatagaaatccagattttcataagaaaatgaaatagaaggatactgcatctttaaaaaatagagtgaagatattttactgtattcgtaacatatgtgatagtggaaaaagtattttcaaactcacaaattttacagaggttgtaaatagtttgatgaagtatgttgggaaagagagcttctagttttcatcacaataaaaagaaaaaacttgttcagatatgccttgtatatcttacacacaatgagtgaaattgccatgggaactctgtccaactttgtcagagcatgctcttcgtgttctgttcaaaatagagtggccacttgtcatggtttagccaggatggtttaaaatataatgaagtcattttaagttgcagacaactgattccaaactagtaatgtcttttcctgaaaagggcaaaacagctgcacaggattttgcttgtactaaagaggagcatcttacaattgttctcttttctcagttatctccctcctcaacagagtgtgaacaaccatacaggtgtttattcttgttttattccaggagactgcttttaggtataactacatgttgaaagattaagtgctgtgcatatggccacgtgttaaaggaatctatactcgcaataggaataagctaatgcccattttcagaaataaattaaatgctgaaagtgcctgtcagtaaaccttatgaccaatgagatattcctatacttttacacagcaataattcttaataagactgggttttttcctgcacatgtgaacacacacacacatacacacagagagagtaaatacatacacatagtaaatcaaatctgttcacatgcccacaaaaaacgcttttatagctttcaaatatacctaatcttgtttacattaacatttcttaatttgatctttctaacttgcagaacgttaagaacacaaatctgaacattaagtttatcttcagtgaacactattgcatatggtaattataatttccagataaaaagttgactgtcatttgccccaaacttatgaaacagtatgtatgattcaaaaagttttgctcagttaaaaacaccaatttatttggcgcaaaagactgaaggatatttgtttgcttgttcattttatccactcatatcaaacgcacaaattcatctttacatttcttcattcccctttcccctaatatttcctattatcatcttaagaatcattttggaatgaatattgacagaatcatttctccccaaaaagtctgttgaagtaccactgacacttagtaagcctagcctttaaccatctttgcagttagtcctaaaaattaccagatgcacattcagaagctcacaggttttttcctgtaattactgtactgctaaaagtggagtcatggatagaaatatacaatgagactatatgaatagacatgaaccctggaaattctccaaccctgccatctcagagcacaaattcacccaaacaagctactgaggctatcagtaaaattatactcatggagagtcacacatcgggtaagggcaattttaaaagtaggactgtgattaaacattcaggctttagacttccatgatggactcagaccacaggcctcaaaaaaacatccactgttttctcctcccaatgttagaaagaagaaaagggagaaggaaatgtaccaggataagggggtaaaataaccaattaagtgtcaaaggaaagctgctgggttccttaatctcactgaagtcaagtcttctgactgggcttctttccatgtgttgtctgaaaaaactaaagtaccttgaaaggttacacattcagcaaaccatgaagataatagctattctttattaaacactgtgtgccaagcaatagactaggcaatttttagatacgttacctgcaacctgtacaacatttctacactttatggatgggaaacggagacatgggaagtgtggctgagttgttcatggatgtagaaatagtaaacggcaaagtaggaaagtgaaaccgcctatctctgacctggaggtctgcctgtatctttcccactccaccacactgcacgtgggtgtcccgaaaccaccttcccagattcctgactctcagtaattttattatggacaacatgcatgagtagtcatcatatttttcaagtgaaatatcgggacatgatataacacatgacttaacaatggtactgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagttgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcaaaaagtaagatattttagggacataccaacatcttccctttctgctaatttcatgctccaaagatatggcaaaaaaaaaaatcataaaaagtgcttttgccctacttgtgttctagttttcccatggcagaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaactccctaactgactcagacactttggaaatcatagttattaaccattctaattaaacctttgttatgaaaagttttac

SEQ ID NO: 736286 - DNA, 629 bp, Homo sapiens
ggggctctgctggcagaaagggggtccatcctaggcatgggtactgacacaggtgacagcatctgcataccagccagcttctgtggtgtttatggcctctggaccacaggttcccgcctcagctacactggaattgcctctgccatcaaggggaaaaaaatcggtgaccacggtggctggccccatggcccaggacgtggagagcctggcgctgtgcctgcaagccctgctgagtgaagacatgtaccgactggaccccactgtgctccagatgccctttagggaggaggtgaagaccccctttcccaccccaggctgcagtgagtgagaagcccacatgctcagtccagtttgtttccttcccctgctggacaccagctgctttggcttcttggctatctggagccatagcttgtaagtgcccccaaagagggcctccagtgccatatacccaacccatgcagttagaatactcagcaagtgtggttgagagggtgtggcatccagttaagctgggtttttaaccctctaggtaaccctggccaagtcacatctcttctttcagccttagcctccccatcaatacaataaagaggttaggctgggagattactccacacccttctgtc

SEQ ID NO: 736287 - DNA, 1268 bp, Homo sapiens
ggggctctgctggcagaaagggggtccatcctaggcatgggtactgacacaggtgacagcatctgcataccagccagcttctgtggtgtttatggcctctggaccacaggttcccgcctcagctacactggaattgcctctgccatcaaggggaaaaaaatcggtgaccacggtggctggccccatggcccaggacgtggagagcctggcgctgtgcctgcaagccctgctgagtgaagacatgtaccgactggaccccactgtgctccagatgccctttagggaggaggtgaagaccccctttcccaccccaggctgcagtgagtgagaagcccacatgctcagtccagtttgtttccttcccctgctggacaccagctgctttggcttcttggctatctggagccatagcttcccccctctaggatccccaaactagccagcatcttgaagagattcgtggagtggggacacccaagaaactgtgggaacagcacacagcagtggaggaatatgagcaagagttcatagccaagtggaggtccctggacctggatgtgctgctggtgccagttctgggctctgccttctatataggctcttcctccctagcatcagaaagtcagtcttatgtgaccctgtacaacctcctggactttcccgcgggcgtggtgcctgtcactatcgtgacactacaggacgaggaggaactggccttctacaaggggtgctacggagatagttctgacaaaaatttctcagaggcggtaagaggatccgtcggagttctggtgactgtgcagtgcattgctttgccatgggaagaggagctgtgtctccggttcatgaaggaggtggacaccttggtcaagaatcagagggggcccaagtgataggctcctggaatggagtaacagctcatgaaacacggggctggttgtggtggctcatacttgtaatcccagcagttcaggaggcagaggctggcagatcgcttgaggccacgagtttgagaccaacctgggcaacatagtgagaccctgcttctaaagcattttcttggtgttactcctgtagatcctcacccaagtgtgctcctgatgccccttccttctcatgaataccatgtccaccttatgtctcctccttctggaaccccaccaggttccttttctttgttggtccctctgtgtgggtgctcaatattcctcagatgggcccaggatggggagcagggtgaggagctcaataaacattttctgactggc

SEQ ID NO: 736288 - DNA, 1062 bp, Homo sapiens
ggggctctgctggcagaaagggggtccatcctaggcatgggtactgacacaggtgacagcatctgcataccagccagcttctgtggtgtttatggcctctggaccacaggttcccgcctcagctacactggaattgcctctgccatcaaggggaaaaaaatcggtgaccacggtggctggccccatggcccaggacgtggagagcctggcgctgtgcctgcaagccctgctgagtgaagacatgtaccgactggaccccactgtgctccagatgccctttagggaggaggtgaagaccccctttcccaccccaggctgcagtgagtgagaagcccacatgctcagtccagtttgtttccttcccctgctggacaccagctgctttggcttcttggctatctggagccatagcttcccccctctaggatccccaaactagccagcatcttgaagagattcgtggagtggggacacccaagaaactgtgggaacagcacacagcagtggaggaatatgagcaagagttcatagccaagtggaggtccctggacctggatgtgctgctggtgccagttctgggctctgccttctatataggctcttcctccctagcatcagaaagtcagtcttatgtgaccctgtacaacctcctggactttcccgcgggcgtggtgcctgtcactatcgtgacactacaggacgaggaggaactggccttctacaaggggtgctacggagatagttctgacaaaaatttctcagagccaccatataaagaagtccaggctatactcctagaggccacatgcaagagaactgaggcatcccagctgacagccagcaccaactgccgggcatgtgagtgaactttcctagaatacgaccctccagctcccatcaatcaagactgaagatgatatagccctggacagtgcggcttgactgcagcctcatgagacacccagagtcagaccacccagctaagctgctcctggatttctgaccctcagaaactatgatacaataaatatttggcctcgtaggcctcagtttgggggtaat

SEQ ID NO: 736289 - DNA, 433 bp, Homo sapiens
tggctccactagcttcagcactgccgaacttcctgccccagtccggcaggggccgaccttgcccagtggctaaaccacagaagccttggggagcccggctccttctcccaactttacctgaataatacagcagttcaggaggcagaggctggcagatcgcttgaggccacgagtttgagaccaacctgggcaacatagtgagaccctgcttctaaagcattttcttggtgttactcctgtagatcctcacccaagtgtgctcctgatgccccttccttctcatgaataccatgtccaccttatgtctcctccttctggaaccccaccaggttccttttctttgttggtccctctgtgtgggtgctcaatattcctcagatgggcccaggatggggagcagggtgaggagctcaataaacattttctgactggc

SEQ ID NO: 736290 - DNA, 386 bp, Homo sapiens
tacccaccccagtgtgtgccaccctcaggagcccctggcaggaccaagactcagggtcctcattgtgggcctctgcagcttgtggaagccaccatataaagaagtccaggctatactcctagaggccacatgcaagagaactgaggcatcccagctgacagccagcaccaactgccgggcatgtgagtgaactttcctagaatacgaccctccagctcccatcaatcaagactgaagatgatatagccctggacagtgcggcttgactgcagcctcatgagacacccagagtcagaccacccagctaagctgctcctggatttctgaccctcagaaactatgatacaataaatatttggcctcgtaggcctcagtttgggggtaat

SEQ ID NO: 736291 - DNA, 2035 bp, Homo sapiens
tgggggttataatatacccttcgaggccatctatctccctcatcacacatacaccaacttaatataaacccttttcagagaagataaaggaattagctgtttaatgactacattgtggtgaagttttaaagccactaaatgggaggtccattcccatggcaccattgctagcagcccaaacacagtctgcagaaacactcatttcagtggctgacttcagtcagtaattgatacagcaaaatttcattctaacatttcaaagctgtctcacagaatttctgagaaaaaagtgttcccaatcactgatttcatcatatcgcgtcaatattacttcagcacctttaatgaggaaatcattgaaacacactcatcatctttggctagagagatttatgttactcagaggttttgcagctggtgtggcagtgggtggcaatagtgaatttgcagttttgaaaaaaattaaaaagttacgagaagaaaagagaataaacaaagagaaagggaaatgaagcaagaacaaaagagactcaatcatagtgttagaaaattcctgcaaacttcttgatcctgaagtctccaaaaaacctcagacctcccaccgatgttacagtatctttcatctggggctcaatctaagaatcttttcggttcctggtaattcctctgagtgcttcatgtctgtcatcacagttttattaaagaactttacttgtgtttggaaagattgtgtgcatgcgtgtctgtagccagttgcagacgtattgtctcagtaagaaaataaatcctatttgttttatgaaatcagtacacaaataacagttgccacagtgtaccagtatttcaatttctaaagaataccatagagtctgaattagaacctttaactagattgcaaaggaatatactaaattgaaaacttgtaaaagggaagtaataaacaccataatcctagataagatcctatggtctttcagagtttttccatatacagtaattatttgatgtacagtaattattgataaccaaaatgacaaaaactgaatctactcttcaaattcaaccatgtatcttaaaaaggagtaaaatgtactgttttcagtgtttcctttggtttcttacagtttataattttataaattaacttcatagaacatattttataaatgttctgtctctcctaacataaattttgaattataccattgttatttgatagtacaaattatgtaaagtaatatgcaaaataagaacacattttgccttaaattgtattttgatattttagaaccatttctgaaaacagctcattttaacaagacgagatgtctgataacagaagagaaaacctgtctgacttaggtttaagctcaggcgaaaaagaagtgttttaagcatttgaaggaactgataatacctttattagagttcatctgttcttttactatatgaaagtatgtcacggagctgaactgtacctgtttgtgatgtgatacctccttttctcagtcaactgcacgttttcaacttaagtttacttaaaattttctgaaaagaaatgtacaaagacagccttcaattaaggattaatcactatggcaactgagatgtggtgactgaagggggaggatgtattctcccctcagtttcctgccagctgtcatagtcaacctctgctgcctgaatccaagccaaaatatagactgtgaccaactctaagaaactatatctgtatttttataaattggtacaagtatcagactataaaagaagacttaatcccttgaattggatgacagacacttggcactcttgcaagtgtttgacagagaaataacgggtcgctttgtagtaaaacctggattaatagtaagcccctctttatgttattgcagtgtggtgtaaatgagagaactaagcatgctgtcagcctggggtgggaggtagcgtgggggagtgtcttttatataaccagtgcaggtttaagcactgttcagaatactgtaaatacaaaatattgtgttagtaaaaaaaa

SEQ ID NO: 736292 - DNA, 452 bp, Homo sapiens
attgaaacaatgttctaatttcagtgtatttgttaattagagataattattatttgaagttggatatatcttaaggtttttttccttgaaagcaaaagtttccaaaaaagtatttctttaaaaaatatttgtctgtaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagag

SEQ ID NO: 736293 - DNA, 753 bp, Homo sapiens
cgccgccgccgccgtcgcccgcagcaccgcgcgggcctctgagttgcagggcctgaggagccgcgtgctggggactggacgtccgctggctgctgccgcacgcgagaacctctcgcttccctgtcaccaggtcctcgcggaggaaggggagggacgaggcgcggcttttcctgtgccgcctgcccggttcgacctgcgcggcctgcggcttcttgggaactctagggccgcggccgggcctggctctgccggcggcctgttgggagctggatcggagcggtttggaacgacaagcccgacaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacgctttattcatatatagtatgatgtaatttttaagagactggggcctcactatgttgcccagtctggcctcgagctcctgggttcaagcgattctcctgcctcggcctcttcagtagctgggactataggctgtgccaccacacctggctttataatgtaattttaaggaaatgaacctaaagttaagtcagatatgatttactatatgaagatacaagagtatttcaagttgaaggggttagccgtgtttggggtagtgtaccagtaacctccaaaaactagacatttggtt

SEQ ID NO: 736294 - DNA, 433 bp, Homo sapiens; identical to SEQ ID NO: 461242

SEQ ID NO: 736295 - DNA, 814 bp, Homo sapiens
cggacgcccggcgagtggcggaaagcgagaccccggcgccgagtgaggtcggccaggctgctgccgacttccccgctggcccctttgttcccctcccggggccctgccggcggcgggtcccggttgcccgcgccagagcctcaggccggctccttttgcccttgagaagggttcgctgccaggccttcgagttccgggcgcagctcccgggagagccggcgccctgcctggcccggcggcctcctctcgggcacgaaggcttgctgctgcttctccagaacttcccttcctcgtagacacagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagctgaacagtgtgtaaaggtaagtattacttattggctcattacttatttttctcagacctctcagggatgagtattggctcatttaaacatcacttagagactgaaaaatgtatttactaaaaaaaaaaaatt

SEQ ID NO: 736296 - DNA, 1589 bp, Homo sapiens; identical to SEQ ID NO: 461243

SEQ ID NO: 736297 - DNA, 2084 bp, Homo sapiens
cggacgcccggcgagtggcggaaagcgagaccccggcgccgagtgaggtcggccaggctgctgccgacttccccgctggcccctttgttcccctcccggggccctgccggcggcgggtcccggttgcccgcgccagagcctcaggccggctccttttgcccttgagaagggttcgctgccaggccttcgagttccgggcgcagctcccgggagagccggcgccctgcctggcccggcggcctcctctcgggcacgaaggcttgctgctgcttctccagaacttcccttcctcgtagacacagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagctgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagag

SEQ ID NO: 736298 - DNA, 1891 bp, Homo sapiens; identical to SEQ ID NO: 461240

SEQ ID NO: 736299 - DNA, 2137 bp, Homo sapiens; identical to SEQ ID NO: 49224

SEQ ID NO: 736300 - DNA, 2424 bp, Homo sapiens
tgcagcattttccagtcacatatcagggttatactgaactgcaacaaagatcaacttttaaaaattagccttcttaaaatacaaaatgatttaagtattttaaagataatttatttgccttgctcttgccttctaacattagccatttcatggagaggctaaaacttatactccaaaaaatgtggaagcacattttaatgggagtaaaattaaaaaattttgagaaagggtaaaatcttatgaatatgcatcttcttagctttatcttccctttgataggtaggcacttatgctcttccatctgctccatgtcaaatagggctcagggaagccagtcatttccttagcgagatgattactcctttgccttgaaacatttattgggcccaccatgtatggatcagtgtgtggtagtgagtcatactcccaaatcagtgattcccaagtcttggctttgggaaccagtatgccttgtattctcttaaaaagcaacaataatttcttgaaacaaaattagttcagaattgatttaaaatatttcagtgtgccatatagctctgtcccttggtttggttggccttgttttttcctgtgaagaatgaaagggcaaaggtgataccaaaatgaaacagctttggagtgatatctttaggagcctggaagccatttttgtaattttgttgtctatataaatgctacctttgcctggaggtagtgcgcctgtggctgtgtacatccagagggcaacagtaatagccaacaaccagacaaactagtgaagttaatctgtgagtgatgattttatgatacttatatgcaaattaaaggcagaagttagtttcttctcaagatgcctttttggctgaacattaccatttttctttccccagggtttgaaagaaaagggccttttttggatttaactatattctgtctgcattctattcttcatgcgtaggtttctactagaacctgtggaggggggacaccaaatttagattgagtcagtccatgctgataagaagcgtgaggaccttgttggacacagagcttctagatctttccacctgtagcctctaccctgttcctgcactttacctgaaactgtgcctctggtctttagaccagctgttggaacatatcactcacccactcctctgttatagcaaagggccagctgggatggtacacgctgtgtaatcagacaccttctcgacaagtacagctgatgtttctcactgttgccttaccattctctgagccatctttgatgttgatttgtaaaaaaaaacaaaaaacaaaaaaaaaacctagtagcaaaactcctgttaaactcagagcttgtatgtggtggtcattcaacatccttatttctagatttacacaaactgtaccaactgtaatctttttctggcacgcgtatgtggtcagatgcttcataaacgtgagccaacttgggttgtaaacattggacataatatacaaattggggaattttggatgactgcataatcctgtcattagagatttcataagacagaagataactgtttatttgtaatttaacacatttttagaaaagatgatctttaatttctttccctcagttgtgtatacagctatacaccatactaacaccgtactatgtcataggaacttaaagttagatgtatctaaatcccttcacttttctaagacttctctgtgctcccacccctgaagtcttcaaatcatttttcatctgtgaagtcactgaggtactgggcttgactatagtggtaacagttaaggggagttgaactattgatcttccaagaagaaagggaccagatagtgttaagatgctgcagttgtgttactgtgaagaaaagattcgcttccactttcagcaggctatataaatatatatacatatatatatatattttcactttggtaaaaaaaagttgaaaaatctgaggagaacataattaccttcacaaattatttatagatacactgggtgagaagcttactgtagggcagtcacccaaaaaaaactaattttagtgctttcaatagtgtaatatttgtatctattaccatggcagcagtgtctgctgcacactgtgtcctattactgtaaatctcctggtttataattcttatggaaactaatttgttttgtaatggaatccagagcagatatgtataatatgatcaggattgtcctacagttgtaaataagaataggtcctgtttattttgacatctttttacaaatgcattgtattagggtgtgaatattctgaaccatcctcttgtttaaagtttggaaatttttattgttaaatgtaacattttaatggttgtaataattatttgtatagatatgaatatagtattttatttaagaaaataaactttgcatttttgcattgtaaa

SEQ ID NO: 736301 - DNA, 2019 bp, Homo sapiens
ccccaaccgcctctcagccatgcgggaggccttcgccaggagccgcagcatcagcaccgacgtgtgacctgggcccgcccccgggatcctggccttgaaggtcctgagacaatggggggattcctttggcacacccacctggccccaggccccaagtggggcttggctgagccctcctggaatccctgtcctcaggggaggcccaggcttggggagcccccaggctcgtggcagggataaggctcattgaacacaaatgtgtcctggggggaggcacagctggggcctggggctagaaggaccaggtgaccatacagccggctgggcatgcaccagggctctcaggcacagaggccaccgttactcctgatgattctgtctcagacccaacaacctggccttcccaggaggtctccatgtgtcaccccctccctgggtctcacccttctcacctgctcaaggaagggatgacctcagtgaggcccagggccctgcagcaaggccctccctggcaattgcagaccaaggattctgctcctccaccttgaactccagcctctttctctccatttttccctctctctcccctacccgtctctccctctctctcacacacacactcttccgggttcaagggccaagcgtctgcctaggctgagacacgtgctgagctccctgaagatggaccagctgccccctagaagggagactttcaggggcatcagggcccttgggatgctccgccctgaccagctttttggtggcagagggaggcacggggagagggagaggccatgtcgcagtccccctgccgtgggagaggcaacgcggaaatgtatagacccagtgctcagccagaaacagggccagcaagcggcagtgaacggaggcagcccggggctcgtcagggtgggcagagccatggcccaggggttgaaaacccccgagttccccgtgagacttggctggcccttcccacccctgggcctcagtctccccatcttgtgtgatgaggagagaccctgaggacagaggtcttcaggctgtgggtctcaacaggaactgagatccccaagggagacagagttgcaggtcacctcccctacctgcttctcagcaggacctaggaggcctggcccagctcctggtggaccccaagcagccagagcctactgctgccatctgaagacctcatctgagcccactttccaccaagcgcccacccaggctgaggtctcctgggaattctcacccgctctcctgctgctaaggaaatgacgtcaatggctaccccagagaaatgccccacatcccaggacaccagccatcaggaaggcagctcttcctcacccagaaagaggcaattatttcctctcagcagcctggccccaggagcccccttccctctctggggctctgcctctccttttgtgccctgccatggagccccagggccggggcagcccctctctgcccagggaaggcaccgccctcaaagacaaggcttggccgggcagtgaccttccctgagcggaggggtggcttgagcaggacacttcttgcccttactcaaaaacgaaatggccagtttccagaggcgtcgggggaacggctgacgaagtcacaatcgttatgttctcaattgttttcctcctcttactttctctcctgcctcgtttggacaggccagtggcattcgcccttgaggtccctcgcagccccggccccccgggcccgcccacacctctggcttcctctgtgcatcctgtgaagtctgtttctgatgcgttggcgtggggggtgggctgggtggggtggggatgagggcccagccctcatgattccatttcccaattcctttctggtctccatcctctctgtagatatgtagatctctttgaaacgaagtaagcacccatccctcccagctcactcggctccaccgtggggacctgctgggggagccgctggctccctgaggaaagtgaaagccaataaaacatctcccacactctcatg

SEQ ID NO: 736302 - DNA, 1299 bp, Homo sapiens
ggattaatgaggaaatcattctgtggctctagtcataatttatgcttaataacattgatagtagccctttgcgctataactctacctaaagactcacatcatttggcagagagagagtcgttgaagtcccaggaattcaggactgggcaggttaagacctcagacaaggtagtagaggtagacttgtggacaaggctcgggtcccagcccaccgcaccccaactttaatcagagtggttcactattgatctatttttgtgtgatagctgtgtggcgtgggccaaacatttaatgagaagttactgtgcaccaaactgccgaacaccattctaaactattcatatatattagtcatttaattcttacataacttgagaggtagacagatatccttattttagagatgaggaaaccaagagaacttaggtcattagcgcaaggttgtagagtaagcggcaaagccaagacacaaagctgggtggtttggtttcagagccagtgcttttcccctctactgtactgcctctcaaccaacacagggttgcacaggcccattctctgatttttttcctcttgtcctctgcctctccctctagctcccacttcctctctgctctagttcattttctttagagcagcccgagtgatcatgaagtgcaaatcttgccatgtcagtcccctgcttagaaccctccaatggctcactttctctttaggcaaaagtctttaccccatgccttctcccatctcatctcaaccccctcatttgttggctgtctgctgtcagccactcttctttcaggtcctcagatgcactgcaccctctcctgcctgggggtctttgctcctgctactacctctgcttgaacagctcctcaccttccttcctccaaccctacccttgtataggtgacttttgttcatccttcagaattcaactcacatgtctcttgcatggagaaccctcacctactgtgttgagaccctgtccagcccccaggtgggatcctctctcgacttcccatacatttctttcacagcatttacatagtccatgatagtttacttgtgggattatttggttaatctttgcctttaacaccagggttccttgggtgaaggagcttctttatcttggtaacagcattatttcaagcataacttgtaatatagttatattacatatataacatatatatatataacataacatatataacatatataacaagcataacttgttatatagtcttgtatatagcaaagaccccaataaatatttggagaacaaaaaaaaat

SEQ ID NO: 736303 - DNA, 521 bp, Homo sapiens; identical to SEQ ID NO: 45594

SEQ ID NO: 736304 - DNA, 654 bp, Homo sapiens
gctctggcccggaacatctggatgtgaaagggcatttggtgattgcacctctttctccagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaatggattatctttagaaacctcttgattgacttactacttggaagataaagcacttggtgatcaagaggggctcctggtggggtggcgcgtccttgataaatctctaggtggcctcccgccaacagctgctgtgtacctttggctctgaattaggaatatctttactttctcttttccaattatg

SEQ ID NO: 736305 - DNA, 5535 bp, Homo sapiens
gagcgcacggcggcggcagaggcggcggcggccgggcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaaaaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagcttccgggggtgcagtggcctgcccgagggggccctctgacacggagcgagaggagcccacagagagccagggcctgggctgccccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggcgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaatggattatctttagaaacctcttgattgacttactacttggaagataaagcacttggtgatcaagaggggctcctggtggggtggcgcgtccttgataaatctctaggtggcctcccgccaacagctgctgtgtacctttggctctgaattaggaatatctttactttctcttttccaattatg

SEQ ID NO: 736306 - DNA, 1198 bp, Homo sapiens
gctggaccggtccggattctgggaatcgtcgaccacgcgtccggtcgaggacagagccccccgggcaccacttcacaggccacagaagccccgagaaggagcctgggacatggaggatgtggcccccacaggggtcaggcaggcgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaatggattatctttagaaacctcttgattgacttactacttggaagataaagcacttggtgatcaagaggggctcctggtggggtggcgcgtccttgataaatctctaggtggcctcccgccaacagctgctgtgtacctttggctctgaattaggaatatctttactttctcttttccaattatg

SEQ ID NO: 736307 - DNA, 5173 bp, Homo sapiens
gagcgcacggcggcggcagaggcggcggcggccgggcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaaaaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagcttccgggggtgcagtggcctgcccgagggggccctctgacacggagcgagaggagcccacagagagccagggcctgggctgccccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcgggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaatggattatctttagaaacctcttgattgacttactacttggaagataaagcacttggtgatcaagaggggctcctggtggggtggcgcgtccttgataaatctctaggtggcctcccgccaacagctgctgtgtacctttggctctgaattaggaatatctttactttctcttttccaattatg

SEQ ID NO: 736308 - DNA, 3128 bp, Homo sapiens; identical to SEQ ID NO: 387235

SEQ ID NO: 736309 - DNA, 2844 bp, Homo sapiens; identical to SEQ ID NO: 387239

SEQ ID NO: 736310 - DNA, 5688 bp, Homo sapiens
gagcgcacggcggcggcagaggcggcggcggccgggcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaaaaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagcttccgggggtgcagtggcctgcccgagggggccctctgacacggagcgagaggagcccacagagagccagggcctgggctgccccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggcgttctccgagctgccctttcccagtcacgtgcttccggaacccgggttcccagacacagacccctctcaggtgggtgtctgggctggagggctgtgggccgtgggcagtggcctggcacccgtgccacacacaccacactaggctggggctgaggcctcacagctcctgggcacagagctgctagctgtagggcccagtgctcagcaggggtgtccctcccaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaatggattatctttagaaacctcttgattgacttactacttggaagataaagcacttggtgatcaagaggggctcctggtggggtggcgcgtccttgataaatctctaggtggcctcccgccaacagctgctgtgtacctttggctctgaattaggaatatctttactttctcttttccaattatg

SEQ ID NO: 736311 - DNA, 5192 bp, Homo sapiens
gagcgcacggcggcggcagaggcggcggcggccgggcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaaaaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagcttccgggggtgcagtggcctgcccgagggggccctctgacacggagcgagaggagcccacagagagccagggcctgggctgccccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggcgttctccgagctgccctttcccagtcacgtgcttccggaacccgggttcccagacacagacccctctcaggtttacagccccggcctgccgcctgccccggcccagccctcaagcatcccaccaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaatggattatctttagaaacctcttgattgacttactacttggaagataaagcacttggtgatcaagaggggctcctggtggggtggcgcgtccttgataaatctctaggtggcctcccgccaacagctgctgtgtacctttggctctgaattaggaatatctttactttctcttttccaattatg

SEQ ID NO: 736312 - DNA, 2305 bp, Homo sapiens
gtctatctactgaatataataagaacatgtttttcccaccttggtttggtttccttgtggcatagactgtagcaaggaatggaagttttccttccaatattcccagtgccagaacagcatctggcacacaaaggcattcaatatgagatggtaaattaatggacaaatgaatgatgaactaatgagtagaaaaatatataatgtatgtaaacacatttatctttcctgataagtacatgctctttgtttcaaatattttatttaattttataattcagctgttaaattattgaactctatatagcctctgtagcaatgaccaaagctttgttgagaatcatttttagtcagagcactgtttttcctccattttcctccatgggtttctcttccagtaacaaatgtgatccaaagaaatgtaagcatagacatgaaaagggataatgccgcctttaaaactgttttctagtttgttgttagaagttataaaaatacacaggaacacagcattcacttgaaaataaatttttaggcattttaaatagattaaagcagaagaaagagtgagaaagtaaccattctaaattcttaaaaagagaatagcacctatgaaaatgaaataaagaatcatgaataacatcaggaagtcaggaaatgcagaccaacagtaaaagaatgctattaatgtccaaatgacttatttttattttgtgcagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctgggaataaaacaagaatgtctcagtggcttcattactgctcccttttgtcttcaattaaatgaaaagaagatttatttccatgtgatttgattcaaagaaagtgctccataaatgcagaagagtaggttttgttggaaatcgtgtcagttgtaccctgaccataaaatatggtttctattttcataaaacagcattattcacatggcatttccaataatctggattgaaggaagaaaattttatgaaatagctttagataaattaataggccacgttcattttcttgtcaaaaagttactggtggggggatggtgggaaaaagttattagtgcaaatttcctagagaaaaaaccatttctctttcaaattttccagttgaattttatgttcgcttttgcttcttaggttctatcacttaatattgaaagttaatcagaaataaaatgtaaacttctatttcagatagctttgtaaccatttatcagaaagtataataatgtgatatgatatataatgtggtatttttcagtttacaaggcacttccatctggtcctaaaccctgcaaacaaaagtgtcaaggcagacctagtgcagagatgagggcatgggggctcagagaggtaaagtgacttgccaaagattgtgaagccagttaagggaaattggggatttttaggacatttgtctcccagaccatttctacagccaataaaagccttgaaaattacctacatctctagtaaatctttctgaggtcagttacacagttcaccattcccagaattctatgtaagagagaaattaagggagaatttggttgtcagcttccagggaggtaccttaaaacatccttattttctttcataatacaccataggcactttgtggaagttattttcttgtacagccagtgccacttttggatgacatacaaagcagcaggagttgacgctatgtgaagcaacacttctcttccatacttccatcacatttggctcacctacctgagtttcagccgtgaccatagtgcccagaggaacccgagcctttgattcatccttgctgttttgagaggcctagggagtgtctcttagcctcctgacatggaaagccttcatgctatgcaaataaagacagctgggggaacttctagttagtggtggtagattaaataagcatacctgagagaaattcaaagttagacttccacaaggcaccaaggtgcagcacacatgaaatatgaaagtgagaggttcaaaggaaatgactgaggatcagttagatggttctataccccacaaatatgtatgagagtcaacagaattttatgag

SEQ ID NO: 736313 - DNA, 1645 bp, Homo sapiens
atgtggttcgtgactgagccaattctctgggcatttttcctattcttaatgctaatgactatccactgctggtcctcttatctgtttactcaaaaacacaaactgactctcatccttgtgtttcaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccaggtgagaacagtaacaataacctattgtattgtcaagtgattggaataagtagagaactcaggcaggtaaaaccactctggagattatctcatctccctgcctccagcaagaccatcagaaaaactgcatggaaacaataaataga

SEQ ID NO: 736314 - DNA, 1422 bp, Homo sapiens
gattgctgatggatcagtgagcctgtgttcatgccagtgagctgctgtggctcagatactgatactttctttccaaacagcataagaagtgattgagccacaagtatactgaaggaagggctccctcgagttgtggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgaatgtcactcttgtcgcccaagttggagtgcaatggcacaatctaggctcactgcaaccctgcaacctctgcctaccgggttcaagagattcccctgcctcagcctcccaagtagctggaattacaggcacctgccaccacatccagctaactttttttgtatttttactagagacagggtttcaccatgttggccacactggtctcaaactcctgacctcaggtgatccgcctgcctcggcccccaaagtgctgggattacaggcatgagccaccacatctggcctaggaccttaaatattggaaagcatcctcaaaactgtgggtcagtgagtagaactacaaaacaatagcagtagggcagaaacttgaaagaaggcaggagatcatggtgacagtggatgggaaaaagtgagggttggggataagggttgcgggttgtcgaagggtggattttctccttcagcaactacaggagatatgatgcctcataattcggagccagaagtggggctttgggtgagatatctttgcacagataacatgtatacatcatagttcaaaacccagtagtcattgtttacagcaaataaagaaatatttagtaaatt

SEQ ID NO: 736315 - DNA, 4484 bp, Homo sapiens
gattgctgatggatcagtgagcctgtgttcatgccagtgagctgctgtggctcagatactgatactttctttccaaacagcataagaagtgattgagccacaagtatactgaaggaagggctccctcgagttgtggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcggacagttatacacctgtggaacctggtttaacttcactaaatcaaacctataacaagcaggaaaatactctgtaatcaatagaatggacatatcaatacaaagaaatggaagcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctgggaataaaacaagaatgtctcagtggcttcattactgctcccttttgtcttcaattaaatgaaaagaagatttatttccatgtgatttgattcaaagaaagtgctccataaatgcagaagagtaggttttgttggaaatcgtgtcagttgtaccctgaccataaaatatggtttctattttcataaaacagcattattcacatggcatttccaataatctggattgaaggaagaaaattttatgaaatagctttagataaattaataggccacgttcattttcttgtcaaaaagttactggtggggggatggtgggaaaaagttattagtgcaaatttcctagagaaaaaaccatttctctttcaaattttccagttgaattttatgttcgcttttgcttcttaggttctatcacttaatattgaaagttaatcagaaataaaatgtaaacttctatttcagatagctttgtaaccatttatcagaaagtataataatgtgatatgatatataatgtggtatttttcagtttacaaggcacttccatctggtcctaaaccctgcaaacaaaagtgtcaaggcagacctagtgcagagatgagggcatgggggctcagagaggtaaagtgacttgccaaagattgtgaagccagttaagggaaattggggatttttaggacatttgtctcccagaccatttctacagccaataaaagccttgaaaattacctacatctctagtaaatctttctgaggtcagttacacagttcaccattcccagaattctatgtaagagagaaattaagggagaatttggttgtcagcttccagggaggtaccttaaaacatccttattttctttcataatacaccataggcactttgtggaagttattttcttgtacagccagtgccacttttggatgacatacaaagcagcaggagttgacgctatgtgaagcaacacttctcttccatacttccatcacatttggctcacctacctgagtttcagccgtgaccatagtgcccagaggaacccgagcctttgattcatccttgctgttttgagaggcctagggagtgtctcttagcctcctgacatggaaagccttcatgctatgcaaataaagacagctgggggaacttctagttagtggtggtagattaaataagcatacctgagagaaattcaaagttagacttccacaaggcaccaaggtgcagcacacatgaaatatgaaagtgagaggttcaaaggaaatgactgaggatcagttagatggttctataccccacaaatatgtatgagagtcaacagaattttatgag

SEQ ID NO: 736316 - DNA, 4229 bp, Homo sapiens
gattgctgatggatcagtgagcctgtgttcatgccagtgagctgctgtggctcagatactgatactttctttccaaacagcataagaagtgattgagccacaagtatactgaaggaagggctccctcgagttgtggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctgggaataaaacaagaatgtctcagtggcttcattactgctcccttttgtcttcaattaaatgaaaagaagatttatttccatgtgatttgattcaaagaaagtgctccataaatgcagaagagtaggttttgttggaaatcgtgtcagttgtaccctgaccataaaatatggtttctattttcataaaacagcattattcacatggcatttccaataatctggattgaaggaagaaaattttatgaaatagctttagataaattaataggccacgttcattttcttgtcaaaaagttactggtggggggatggtgggaaaaagttattagtgcaaatttcctagagaaaaaaccatttctctttcaaattttccagttgaattttatgttcgcttttgcttcttaggttctatcacttaatattgaaagttaatcagaaataaaatgtaaacttctatttcagatagctttgtaaccatttatcagaaagtataataatgtgatatgatatataatgtggtatttttcagtttacaaggcacttccatctggtcctaaaccctgcaaacaaaagtgtcaaggcagacctagtgcagagatgagggcatgggggctcagagaggtaaagtgacttgccaaagattgtgaagccagttaagggaaattggggatttttaggacatttgtctcccagaccatttctacagccaataaaagccttgaaaattacctacatctctagtaaatctttctgaggtcagttacacagttcaccattcccagaattctatgtaagagagaaattaagggagaatttggttgtcagcttccagggaggtaccttaaaacatccttattttctttcataatacaccataggcactttgtggaagttattttcttgtacagccagtgccacttttggatgacatacaaagcagcaggagttgacgctatgtgaagcaacacttctcttccatacttccatcacatttggctcacctacctgagtttcagccgtgaccatagtgcccagaggaacccgagcctttgattcatccttgctgttttgagaggcctagggagtgtctcttagcctcctgacatggaaagccttcatgctatgcaaataaagacagctgggggaacttctagttagtggtggtagattaaataagcatacctgagagaaattcaaagttagacttccacaaggcaccaaggtgcagcacacatgaaatatgaaagtgagaggttcaaaggaaatgactgaggatcagttagatggttctataccccacaaatatgtatgagagtcaacagaattttatgag

SEQ ID NO: 736317 - DNA, 4381 bp, Homo sapiens
gattgctgatggatcagtgagcctgtgttcatgccagtgagctgctgtggctcagatactgatactttctttccaaacagcataagaagtgattgagccacaagtatactgaaggaagggctccctcgagttgtggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgaaatggaagcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctgggaataaaacaagaatgtctcagtggcttcattactgctcccttttgtcttcaattaaatgaaaagaagatttatttccatgtgatttgattcaaagaaagtgctccataaatgcagaagagtaggttttgttggaaatcgtgtcagttgtaccctgaccataaaatatggtttctattttcataaaacagcattattcacatggcatttccaataatctggattgaaggaagaaaattttatgaaatagctttagataaattaataggccacgttcattttcttgtcaaaaagttactggtggggggatggtgggaaaaagttattagtgcaaatttcctagagaaaaaaccatttctctttcaaattttccagttgaattttatgttcgcttttgcttcttaggttctatcacttaatattgaaagttaatcagaaataaaatgtaaacttctatttcagatagctttgtaaccatttatcagaaagtataataatgtgatatgatatataatgtggtatttttcagtttacaaggcacttccatctggtcctaaaccctgcaaacaaaagtgtcaaggcagacctagtgcagagatgagggcatgggggctcagagaggtaaagtgacttgccaaagattgtgaagccagttaagggaaattggggatttttaggacatttgtctcccagaccatttctacagccaataaaagccttgaaaattacctacatctctagtaaatctttctgaggtcagttacacagttcaccattcccagaattctatgtaagagagaaattaagggagaatttggttgtcagcttccagggaggtaccttaaaacatccttattttctttcataatacaccataggcactttgtggaagttattttcttgtacagccagtgccacttttggatgacatacaaagcagcaggagttgacgctatgtgaagcaacacttctcttccatacttccatcacatttggctcacctacctgagtttcagccgtgaccatagtgcccagaggaacccgagcctttgattcatccttgctgttttgagaggcctagggagtgtctcttagcctcctgacatggaaagccttcatgctatgcaaataaagacagctgggggaacttctagttagtggtggtagattaaataagcatacctgagagaaattcaaagttagacttccacaaggcaccaaggtgcagcacacatgaaatatgaaagtgagaggttcaaaggaaatgactgaggatcagttagatggttctataccccacaaatatgtatgagagtcaacagaattttatgag

SEQ ID NO: 736318 - DNA, 3069 bp, Homo sapiens
gattgctgatggatcagtgagcctgtgttcatgccagtgagctgctgtggctcagatactgatactttctttccaaacagcataagaagtgattgagccacaagtatactgaaggaagggctccctcgagttgtggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgaaatggaagcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctggtcaactgtgccggtccgctg

SEQ ID NO: 736319 - DNA, 3366 bp, Homo sapiens
cattagaacacaccatacaaatgttagttctatatggccaagacatctgatttaaatttgatgaaacacagcatgtcattgttttctagaacttaaccattttcgcttctagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctgggaataaaacaagaatgtctcagtggcttcattactgctcccttttgtcttcaattaaatgaaaagaagatttatttccatgtgatttgattcaaagaaagtgctccataaatgcagaagagtaggttttgttggaaatcgtgtcagttgtaccctgaccataaaatatggtttctattttcataaaacagcattattcacatggcatttccaataatctggattgaaggaagaaaattttatgaaatagctttagataaattaataggccacgttcattttcttgtcaaaaagttactggtggggggatggtgggaaaaagttattagtgcaaatttcctagagaaaaaaccatttctctttcaaattttccagttgaattttatgttcgcttttgcttcttaggttctatcacttaatattgaaagttaatcagaaataaaatgtaaacttctatttcagatagctttgtaaccatttatcagaaagtataataatgtgatatgatatataatgtggtatttttcagtttacaaggcacttccatctggtcctaaaccctgcaaacaaaagtgtcaaggcagacctagtgcagagatgagggcatgggggctcagagaggtaaagtgacttgccaaagattgtgaagccagttaagggaaattggggatttttaggacatttgtctcccagaccatttctacagccaataaaagccttgaaaattacctacatctctagtaaatctttctgaggtcagttacacagttcaccattcccagaattctatgtaagagagaaattaagggagaatttggttgtcagcttccagggaggtaccttaaaacatccttattttctttcataatacaccataggcactttgtggaagttattttcttgtacagccagtgccacttttggatgacatacaaagcagcaggagttgacgctatgtgaagcaacacttctcttccatacttccatcacatttggctcacctacctgagtttcagccgtgaccatagtgcccagaggaacccgagcctttgattcatccttgctgttttgagaggcctagggagtgtctcttagcctcctgacatggaaagccttcatgctatgcaaataaagacagctgggggaacttctagttagtggtggtagattaaataagcatacctgagagaaattcaaagttagacttccacaaggcaccaaggtgcagcacacatgaaatatgaaagtgagaggttcaaaggaaatgactgaggatcagttagatggttctataccccacaaatatgtatgagagtcaacagaattttatgag

SEQ ID NO: 736320 - DNA, 1734 bp, Homo sapiens
ccagagtataatatactggtgaagtactccttgacctcgaggtgtcatcaaaaatgtgacttcccaagaaaagccttctcccagtttgttaaatcactctgcccttcttattgtctaatgctgcactctgtctcctttacaatattttctatgctgctttccttaagggtaggtgttatgtcagtttctgtcacctctgttgacagaagacttgaatgcaagacctagcatattgctaggcccaaaataggcactcaataaaaccatttgagtgagtggaagaatggatgaaggcaacatgctcatagggaaagagacaggccaaggcagggccattgctacacaatgtgatgggtaccaaggcagagaggtggggtgaggacattgtgttagtctgttttgagctgctataacagaataccacagactgggtaatttataaagaacaggaatttgtttcctcacaggtctggaagtcaggaaatccaagatgaaggcactggcaggttcagttatctggtgaaggtctggtctttttgcttccaagatggcagtttgactgttgcgtattgaggagcgggggaagaatgctgtgtgctcatataacagaaggcagaaggacaaaaagggatgactccctctttgaagcccttttataagggcatctaatcccattcacaagacaggagcccttgtggcctaatcaccttttaaaggccctacctcttaatactgtcacattagcaacacctaagttttggaggagacacattcaaaccatagcaggtgtaaaagacaagcatttaatcagactgtttgtcagtcgataatttttccttccctgcaggagacatgtctatgagtggctgggagacctgtttaattctgggatatagaattaagatggccatctgcctgcaagtagagataagctgcattctccgaaatcaactttgttcatgataaaagtaacattctggcctccatatgccatattctttattgttaatttcttaaacagttaacaaattggttagagaagaggcaggctatctattgccccatcctctacttttttttttttttaaaactaaatacctaatcgttatattgttattcttttgactattattgctctccttaacacatataaaaatagaccaaactgacatgatcatattttataaaaatacgattttcttttcttgaaaaggaaacagaaaaaaggataaatggcttaaattgtctacttatcataactagaattagaaatcccagtctttgtggctgccaaaaaaaaaaaaaaagaataaatgaccaaaaaatgaagtcaaatgcaagtctttcatgactctctccctgtgactgttagtatgaggaaacttaatagttctgaaaataaagatgtaaatttctgcagaatgtaaaacaggataaagtaacaatagccaaaatgtggaaacaacccaaatgttcatccatagatgaatggataaacaaaatgaggtatatatgtacaatggactatgatttagcctaaaaagaagtgcaattcttatatatgctacaacatagatgaaccttgagaacattatactaagtgaaataagccagtcacagaagcacaaatatatgattctatgtatgtgaagaacctagaataggtaaattcatggagacagaaagtagtttccaggggctggtggtaggggagaatagagagttagtgtttaa

SEQ ID NO: 736321 - DNA, 634 bp, Homo sapiens
  misc_feature (603)..(604): n is a, c, g, or t
ccagagtataatatactggtgaagtactccttgacctcgaggtgtcatcaaaaatgtgacttcccaagaaaagccttctcccagtttgttaaatcactctgcccttcttattgtctaatgctgcactctgtctcctttacaatattttctatgctgctttccttaagggtaggtgttatgtcagtttctgtcacctctgttgacagaagacttgaatgcaagacctagcatattgctaggcccaaaataggcactcaataaaaccatttgagtgagtggaagaatggatgaaggcaacatgctcatagggaaagagacaggccaaggcagggccattgctacacaatgtgatgggtaccaaggcagagaggtggggtgaggacattgtgttagtctgttttgagctgctataacagaataccacagactgggtaatttataaagaacaggaatttgtttcctcacaggtctggaagtcaggaaatccaagatgaaggcactggcaggttcagttatctggtgaaggtctggtctttttgcttccaagatggcagtttgactgttgcgtattgaggagcgggggcagggactgcttcagtcganncggccgcgaatttagtagtagtagtcgacc

SEQ ID NO: 736322 - DNA, 504 bp, Homo sapiens
  misc_feature (495)..(496): n is a, c, g, or t
  misc_feature (498)..(498): n is a, c, g, or t
  misc_feature (500)..(503): n is a, c, g, or t
ggactagttagtcaaagtctatttctaaaacatacctccttttcgtcattgcaaaggagaagtacactttactttcaaggctgactttgggcattgagaacacagaaagatgatttcctacattcttagctaattaattttaagtgtagctggaagcctggtgaggcagaacttaaagaagatgctacttcttgacttttaagcagaggcagcaaatcacttacagtaaaaattactcaaggaaatcactcaattggctttttttgctatggaattgtgacttttttcctataatgccctagggaaagaatataactgtacctcccttccttccaatttcttcaatgtccatagctttaaagaagaggtcaaaattttgtataaaggactcaagaacctctcgaaaggacaagctctaagagtccaatctcttaccactctcagcgtcaaggttagggcaccttcattggaaggaaactgcacggtccagttccnntngnnnng

SEQ ID NO: 736323 - DNA, 161 bp, Homo sapiens
  misc_feature (1)..(1): n is a, c, g, or t
  misc_feature (3)..(3): n is a, c, g, or t
ngntggcccactgcactctgtgcaacacagggattcccattgcacaggatggccacagcctctttcaatgatggcattggaagactttcctgttaataagtaattctctagactgcagcagatagaaattgtaatgaatgaagcaacaaccctgccccaaa

SEQ ID NO: 736324 - DNA, 3949 bp, Homo sapiens
caggtgatctacccgcctccacctcccaaagtgttgtgattacaggcgtgagccaccacacccagccctttcactaatttttggcagagttcacaatcccatcctatgtcagaaacttgaacctaacttaagaaattttgagtcatttttttggaggactgaggctttgttctacctactcttgaagaatcctgatgaaatattcaaacacataaagggatggccctggaggtctatcctgcatacctggagagcttctctggtcctgcccaccttgaaagttgcagactttgttgtaacatctatgtgatgagcttccctgtgaagccccatttgacaggtgggccagcagtgttttatcagcactctgatggcccacatttcccaggaaaacttcttgaaacttaccgttgtgggcagtggtcagagcgtgtagttcttatgactgtcttgtttcatctgtggagcacgtgtggagcacgttggtacagcagtttctgtggggtttggcatgggtgattttggttagtaaccatcctccaattgttgcttgtgaaagtcattcataacttgttccttttacttagttttgttgttactgctgttgttgttggtttggttggttttgagaccgggtctggctctgtagcccaagctggaatgcggtggcgcgatcatggctccctgcagcctcaaactcctgggctcaagcaatcctcctgcctcagcctcccaagcagctgggaagataggcacgtgccaccacacccggctaattttttctttattttttttgtagagatgggggtctcactatgttgcccaggctggtctcaaactcctgggctcaagcgatcctttggcctcggcctcccaaagtgcatgagccaccatgcctggcctgtttagttttgtttcaagttgaaatacctttcttgtgttttctaattagaaaagtaatatctactcattgtaaaaactcaaacagtgcagaaatgtagaaagtagaaagtgtaagtccctggttgtcccttctgcctgagacaaccactgctcacagtttgatgtatatccttccagagactctcaaatttaagcaaataatttttattaccatgtctttttatttgaagacgtacatttgcctccaaagttcaacacaagttcaactgaccatatccttccatgacctgaatagatgctatcctttatcacgatgttcaattgcctttgaaagagagtagtccaggtatattcctgatcaaaatttggcatttttgatgatactactctacacagatcagactcatgtgcagaatcgtgcctggagagagaggtttggttaagacagagatttctggaaacattcaaattgcaaatggaaacttgaaacccacaatctaatgaggaatgtactggaaaaataatctgaagagttgacaaattgtgtactagattgaacacatggaatgcaatgcaatgagactttctgcactaaaacttatcctcatatgtacaacaatgatgtgtgtattatataacagtgatgtgtacatttctgacaccccatacataatatacacagtttgtataaatgcatacatttaaaaatatatatgtacaatacagctaacataaaactgtagtacgcctgaaggatattactagtgcctaatattgagtatgagtcactgcgtgttcgcatcaacttggaagtgcagtaattgttataaaattaatcagtgcagccaacattatttatgaatcacatctttgaaactgtgcagtagcatatacatatatatttttaaataacatttttcacagttttccagagttactgttgaaatctgcatcaccaaaaaaaaaaaaagcaagatttttttaacaatgtagacactcttcagacccagtaatctgcgtgtgatttcctatttgtagattcccaagagactttagcagtcaccagccttaatgcatgtacaggatattattgtgacttaatttatctgcagtttttaatccatgtgaaattggaatttataaacggacttggattaaacatgtctgcctttctaaggttgcaaatgttacattaaatgatttatgttgtaaatgagagaagttgagttgtacgtaaaagacatccaccaatttctgtgaatatttttacacggaaacttgagaatcaaaatacgttcaagtcagttgttctggctcccagtttataatctcgaaaagcaatctttttgtttcataaatggcttaaatgtagctcccacagattatcagtatgaagtctgacatttttcatggaaaagaagtatgtttttcttcattataactatagtttactatttgtctttgctatttcctgatacatacacatacgcacacacgcgcgcacatgcatgcacgtatgcacatgcacgctcccagtgtcccagtgaaggctcaacaggaagcttgagaaggtcatctcaatggccacagggttcctgttcaaccagtagccctgggatgccgctttgcttgtcattctttagtgtcacaagttagttccctgacttgtgtgcagtcagggaactgcacacaactgaaaccaacatggtggaatcatgtttgcaatatttggttgagtaaaataagataattttgaactaaagaagacggaggcattagaccagtggcttgacatgaagcatcccctatgtgggagggtaagtttgttaacttcatttttagtcttatctccaacccttttccttatcctcctccccaaactaaagaagcagaaacagcaacaaaagcaaaaccatcccttcacctgatccagcccatgtccttagattcaaatatcctttgtctttttcccattataccatctgacataactcactcgtgtctagagagaaaaatgcagaaagggtttgtttgcagatgggcagttcagttgagtcctcattaaccaggcagaggggtgcagaagaagcctgactcagggtcaccatggagaactcctcatcccagagatgggtgggacaggaacttggctttgcttcaccaaccactgagcttgatactctttcagaggtggtttgtgctaagaaacacccagcagtctttcaagaacgttctcttctgtagctttgcctgctacacagctgaagtctgtccctataagaattatatttgtaaaaagtaatacattttcgaagaaacccggatcaagtggaatcttgaaagtttttttaatgaaaggggaaaaacaacctgaccacataaactgcacttccaaccatttggaaccagagtttatgtcctcattttcccattctcagaagagcacagtttttcaatattacaacttcctggcaaatagcacaagaaatgttcagacttgagatttgtgttccctttgtccagattattctgtatatgtcaccaaaggggttaacttgtttgcttggcatgaggaaaattataaactccgttctcaaactaattacatctgcccacggttttggtttttattattttaattggcactccgaggcagcagggggtaaattttgtgttggctgcaaggggatttaggttcacagctcttactcacagtaatgggaatcaagggattaaatctctgtgtgttactttgaaaatccacctcttacagccaattttatagacattgatctgagggttgaattcagggcactaattgccagtcagtacaagggtcagcatttgtgttgaagcaccaggggtattgatgtagcctgaaaagctgaatcagggacttgggttttgttttgttttgttttttttacccatttttaaaataggaaagctcatccagaaatacttggatctagacatgatataacatagcaccaatgtttaggatttttagagtgctgttgggtaattaaaataatatcaatgttct

SEQ ID NO: 736325 - DNA, 2229 bp, Homo sapiens
tgactccgaggatgactcttctccgaaaggaacattatttatgaatcacatctttgaaactgtgcagtagcatatacatatatatttttaaataacatttttcacagttttccagagttactgttgaaatctgcatcaccaaaaaaaaaaaaagcaagatttttttaacaatgtagacactcttcagacccagtaatctgcgtgtgatttcctatttgtagattcccaagagactttagcagtcaccagccttaatgcatgtacaggatattattgtgacttaatttatctgcagtttttaatccatgtgaaattggaatttataaacggacttggattaaacatgtctgcctttctaaggttgcaaatgttacattaaatgatttatgttgtaaatgagagaagttgagttgtacgtaaaagacatccaccaatttctgtgaatatttttacacggaaacttgagaatcaaaatacgttcaagtcagttgttctggctcccagtttataatctcgaaaagcaatctttttgtttcataaatggcttaaatgtagctcccacagattatcagtatgaagtctgacatttttcatggaaaagaagtatgtttttcttcattataactatagtttactatttgtctttgctatttcctgatacatacacatacgcacacacgcgcgcacatgcatgcacgtatgcacatgcacgctcccagtgtcccagtgaaggctcaacaggaagcttgagaaggtcatctcaatggccacagggttcctgttcaaccagtagccctgggatgccgctttgcttgtcattctttagtgtcacaagttagttccctgacttgtgtgcagtcagggaactgcacacaactgaaaccaacatggtggaatcatgtttgcaatatttggttgagtaaaataagataattttgaactaaagaagacggaggcattagaccagtggcttgacatgaagcatcccctatgtgggagggtaagtttgttaacttcatttttagtcttatctccaacccttttccttatcctcctccccaaactaaagaagcagaaacagcaacaaaagcaaaaccatcccttcacctgatccagcccatgtccttagattcaaatatcctttgtctttttcccattataccatctgacataactcactcgtgtctagagagaaaaatgcagaaagggtttgtttgcagatgggcagttcagttgagtcctcattaaccaggcagaggggtgcagaagaagcctgactcagggtcaccatggagaactcctcatcccagagatgggtgggacaggaacttggctttgcttcaccaaccactgagcttgatactctttcagaggtggtttgtgctaagaaacacccagcagtctttcaagaacgttctcttctgtagctttgcctgctacacagctgaagtctgtccctataagaattatatttgtaaaaagtaatacattttcgaagaaacccggatcaagtggaatcttgaaagtttttttaatgaaaggggaaaaacaacctgaccacataaactgcacttccaaccatttggaaccagagtttatgtcctcattttcccattctcagaagagcacagtttttcaatattacaacttcctggcaaatagcacaagaaatgttcagacttgagatttgtgttccctttgtccagattattctgtatatgtcaccaaaggggttaacttgtttgcttggcatgaggaaaattataaactccgttctcaaactaattacatctgcccacggttttggtttttattattttaattggcactccgaggcagcagggggtaaattttgtgttggctgcaaggggatttaggttcacagctcttactcacagtaatgggaatcaagggattaaatctctgtgtgttactttgaaaatccacctcttacagccaattttatagacattgatctgagggttgaattcagggcactaattgccagtcagtacaagggtcagcatttgtgttgaagcaccaggggtattgatgtagcctgaaaagctgaatcagggacttgggttttgttttgttttgttttttttacccatttttaaaataggaaagctcatccagaaatacttggatctagacatgatataacatagcaccaatgtttaggatttttagagtgctgttgggtaattaaaataatatcaatgttct

SEQ ID NO: 736326 - DNA, 2223 bp, Homo sapiens
gaattgcttattaaataggcatactttatactgtggtttataatttcaaatataacttggggttatggtcctattcactaagagaatgaaagatatccatgagttaaaagaacaaaactaaaaatttcagatctaacaattgaaagaaaattgaggcagtaaatgacctcttttactcttttatgttttacaatattatcatgttatttacagttaatgctgaaataattctcaagtgcaggaatataaatgttaagtggttttatgattccaagctgatatatttcacctgttaaaaattatgctgctaaattagcattagaggccttatgtttggtaattacaagtgtctgggctattggcgcgtctctatatatgtgtgtgctttgttccagtttcttcaaattatctatgtataattgtatgaaatatttaaatagcaaagaagtcaaagaagattgttaaatattcaacaagaatcataaatacctttatatgtattttaaaagtattgggctgttctgaacatgattatgctggtctgtctgccttttagcctgactccttcactcttgtgtgtgaagtctattagcaactttcaataagctaagcaatgttgtaacttgcaaaaaagcctccactctgagaaacagggccttatagagtaggaatgttttcatactgggactactgaaattttgcagatgtgtgcatctgttccatttaaggtgcccttaaatgtgttgaatgtaatgtgttgaatgtttatgtgtaatggctaaagtatctatatgtatgtgcataaaactgtcacaagatgtattctcaggaatactgttacctggagtttgaaaggaataactattaaaaaaaaaagttggggaagattagaaaaaagctcaagataaatgttcaaaatattattaagtacatgactaaaagctaattactacatatgataaatgcagtgttggtaatagtagatcatttcttaagccatgatacttaatgatatttatcttattcagaggaaaaacaaaaaaggtacccacttcccatgtaggaaaaaattagactcagcaaagaggttgcttcttctgaaattagcttttgagagaccttggaataaaccatgtgttatccatgatagtatgactcagatccaattaaaacagtttaaattctggatataggatctcctatagcaaaacattttactttcatttttcagtatttgctgctttctagaattctattagataagctatgtcatttttctgaaaaagaaactgagttattgagtgtattaagacaaggcactgagaactacagtgtcaaaatcaaagggcataaatgggcatggcagtgctggtggaaaaatctgtggtactggtgatctggttagggcctgttgcacaggctgggagtaactggtttgctgtttcaagcctccaagagtaccttaaacaaggtgatagctcctctcttctttagcattatattcctttagtcaacaaagaactttctccactctgctgcccagctctgagagtatctgagatgagaataggatgtgtgtggaggggcttttagggaagaaagggtcataaatgaatagaagtacagtctgaaacatgaattaaatatccttcctcaagttataaaggatactttaatagaacacagtctccagaattcgctgctatcacaccaagtcatgctgttgccctgtgacctcacacttcccattccatggccttgtcttggcagggagtaaaaaatcccacttctttttactttagtgggtctcaactgcagcatttcagaaacaaattttgatttgacactcaggagaataaaaacaagttgagggcagaatgtatttggaaaagcttaagacaaatttactgatattattttatgatcatttaggattacagatcaatttacctccataaatctttgaattgtcactgtgaccacaggatgaaaatcctttattagccattttataggttaaaacaaaaaattgactacacagccgacttccctcagataactatgaagtctattatgagtactgaatgaccaaagaacatggaaaaaatgcatatgaataaatactgaaatgtttatgaaagatatttatgaaagatattaagacttctgtgtttaggtatgcacatatgataaaataaatctaaaaacattaaaaaaaactaa

SEQ ID NO: 736327 - DNA, 2223 bp, Homo sapiens
gaattgcttattaaataggcatactttatactgtggtttataatttcaaatataacttggggttatggtcctattcactaagagaatgaaagatatccatgagttaaaagaacaaaactaaaaatttcagatctaacaattgaaagaaaattgaggcagtaaatgacctcttttactcttttatgttttacaatattatcatgttatttacagttaatgctgaaataattctcaagtgcaggaatataaatgttaagtggttttatgattccaagctgatatatttcacctgttaaaaattatgctgctaaattagcattagaggccttatgtttggtaattacaagtgtctgggctattggcgcgtctctatatatgtgtgtgctttgttccagtttcttcaaattatctatgtataattgtatgaaatatttaaatagcaaagaagtcaaagaagattgttaaatattcaacaagaatcataaatacctttatatgtattttaaaagtattgggctgttctgaacatgattatgctggtctgtctgccttttagcctgactccttcactcttgtgtgtgaagtctattagcaactttcaataagctaagcaatgttgtaacttgcaaaaaagcctccactctgagaaacagggccttatagagtaggaatgttttcatactgggactactgaaattttgcagatgtgtgcatctgttccatttaaggtgcccttaaatgtgttgaatgtaatgtgttgaatgtttatgtgtaatggctaaagtatctatatgtatgtgcataaaactgtcacaagatgtattctcaggaatactgttacctggagtttgaaaggaataactattaaaaaaaaaagttggggaagattagaaaaaagctcaagataaatgttcaaaatattattaagtacatgactaaaagctaattactacatatgataaatgcagtgttggtaatagtagatcatttcttaagccatgatacttaatgatatttatcttattcagaggaaaaacaaaaaaggtacccacttcccatgtaggaaaaaattagactcagcaaagaggttgcttcttctgaaattagcttttgagagaccttggaataaaccatgtgttatccatgatagtatgactcagatccaattaaaacagtttaaattctggatataggatctcctatagcaaaacattttactttcatttttcagtatttgctgctttctagaattctattagataagctatgtcatttttctgaaaaagaaactgagttattgagtgtattaagacaaggcactgagaactacagtgtcaaaatcaaagggcataaatgggcatggcagtgctggtggaaaaatctgtggtactggtgatctggttagggcctgttgcacaggctgggagtaactggtttgctgtttcaagcctccaagagtaccttaaacaaggtgatagctcctctcttctttagcattatattcctttagtcaacaaagaactttctccactctgctgcccagctctgagagtatctgagatgagaataggatgtgtgtggaggggcttttagggaagaaagggtcataaatgaatagaagtacagtctgaaacatgaattaaatatccttcctcaagttataaaggatactttaatagaacacagtctccagaattcgctgctatcacaccaagtcatgctgttgccctgtgacctcacacttcccattccatggccttgtcttggcagggagtaaaaaatcccacttctttttactttagtgggtctcaactgcagcatttcagaaacaaattttgatttgacactcaggagaataaaaacaagttgagggcagaatgtatttggaaaagcttaagacaaatttactgatattattttatgatcatttaggattacagatcaatttacctccataaatctttgaattgtcactgtgaccacaggatgaaaatcctttattagccattttataggttaaaacaaaaaattgactacacagccgacttccctcagataactatgaagtctattatgagtactgaatgaccaaagaacatggaaaaaatgcatatgaataaatactgaaatgtttatgaaagatatttatgaaagatattaagacttctgtgtttaggtatgcacatatgataaaatatttcttaaaccccccccgcccccccc

SEQ ID NO: 736328 - DNA, 2133 bp, Homo sapiens
  misc_feature (1261)..(1261): n is a, c, g, or t
gggaaaggcttcagttatacctcaggtctgcggaaccaccaaagagtgcatttaggcgagaacccttataagtagatgtacatagaggattccatctgggactcagagctttctatccatctgagagccaacacaggagaaaaaccataggaaagtgacatgtaggagggctataggagaaactgatgattttacattttctagtctgcataggaagggaacacctggacgtgtgataaataggttagcacttcagttacaaacttcagtctttaagagtctgttgtgcagcggagtaggctttaaagaaacagtgcagcagtggtttcagtaataatcctcacttccatcagaatctgcctgggagggagcttttacaatgtacaagtggtgagaatgtttccaaggtgctaattatggacatagattctttgtgtgggttgatagctaccaatgggacagtgtagaaacaagtttccacctttctaaaaccagtttggtacatatctttttaaagatcgctttataaaaacaaaaagataacattaacatttattgaaacaagtcactctgagaagaccaggaacaaagttctcttggcagatctgggtgatgtgtgtgtctcacatttttatcatgtttttatgactgttttatcttgcaggtaagctttacagctttcagaggagttgtagtacactacagaaatatgtcttctttccaggttcaaaaagcaaaatctgattggcattgcattgaattattaattaaataaatttattaattggcattgcattgaatttataggttaattttgaaagaatgtggcgtctttgaaatgctgattttttttcactttaaaaaaatgacttttttttttaccactgatagtatttcatatggtccctcagtaatatttcttagagatggttaaaaataggttctgagtcatcttaagcatatttctaggaatttgttttattgctgtcatgaatataatggttttgctccagttcatttcatagtttaacatatcaaatattaggtatcttaaaaatcacaaatgctatttcaccctgcaggttagcagtattaaaatagaatcatcaaatcccccatcagtgggggcgggggggggggttgtagaaacagtctgatatggtttggctctgttccccacccaaatcccatctcaattttaatccccatgtgtcagaggagggccttggtgggagatgattggatcacgagggcagatttntcccttgctgttctcatgatagtgagttctcatgagagctgatggttttaaggtgtagcccttcctcgctgtctctctcctgtccccttgtgaagaaggtccttatttctcttttgcgttctgccatgactaagttttcggaggcctccccagccatgtggaactgtgtgtgagttaaacctctttcctttgcaaattacctagtctcaggtagttctttatagcagtgcaaaaatggacgtaataagtcttatgtacttattggtgagagagaaaatccgtgcattgttttcaaaagaattcattaacgtatcaattcaatttctataacctttgaagtggcagtaaatatgtagtaattgatacttgggagatagttgcccacttgggcaaaaacgcatgcagaaggtggagtttttaaatttaaaacatttttaaaatagcaaatgttaatattccagtttccattggtaggaaattttttagataagttcaggcatatgtatgcaatggaaagccactagaaatcttcaggcacacagataatgacaatgcaggttgctcatgaagtatttagtgaaccaggagagttttagaacaacaattatagcatgaccccattttgttagtatgtttttctgtgtgtatgtttagagcaacagagaaaaaaagatgtgggagaggacatataactacttatctctagtggtgggattctgaatgtataatacatatgttgtacttttatgtattttactttgtaacaaagtatctttcagttttataataacagtagagctattttttataaattagcctgatggaacaatcccttatgattaaagattcatgttgtaacctctaaaaaaaat

SEQ ID NO: 736329 - DNA, 10931 bp, Homo sapiens
  misc_feature (106)..(106): n is a, c, g, or t
  misc_feature (147)..(147): n is a, c, g, or t
  misc_feature (174)..(174): n is a, c, g, or t
  misc_feature (179)..(181): n is a, c, g, or t
  misc_feature (186)..(186): n is a, c, g, or t
  misc_feature (200)..(201): n is a, c, g, or t
gcggggggaggggaggggaggggagggggcgcggggccgcggcagcggagctcgcatcctcggcggggcggctgtgcaggaggcggcgcccgggctcagcgacgancgatcgacgccaaggcgcgcgaccgacgcggctgccggagngatcgcggcctcgagacacgactgcgnacgannngcgcncaggcccgcgcganngcgctccgggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggcctctggggccctcaggagggccagcccatgagctggagctggaggcccgggatgggggctccccaccacgcaccagccactttcgactacgggtggtggtacaggatgtgggaacccgtgggctggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtaccagaccgcgtgcctccaggaacactggtgacgactctgcaggcgaaggatccagatgagggggagaatgggaccatcttgtacacgctaactggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgctcacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattgctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgccaacgacaatgctccccgtttcctgcggccccattatgtggccttccttcctgagtcccggcccttggaggggcccctgctgcaggtggaggcggatgacctggatcaaggctctggaggacagatttcctacagtctggctgcatcccagccggcacgtggattgttccacgtagacccaaccacaggcactatcactaccacagccatcctggaccgtgagatctgggctgaaacacggttggtgctgatggccacagacagagggagcccagccctggtgggctcagctaccttgacggtgatggtcatcgacaccaatgacaatcgccccaccatcccccaaccctgggagctccgagtgtcagaagatgcgttattgggctcagagattgcacaggtaacagggaatgatgtggactcaggacccgtgctgtggtatgtgctaagcccatctgggccccaggatcccttcagtgttggccgctatggaggccgtgtctccctcacggggcccctggactttgagcagtgtgaccgctaccagctgcagctgctggcacatgatgggcctcatgagggccgtgccaacctcacagtgcttgtggaggatgtcaatgacaatgcacctgccttctcacagagcctctaccaggtaatgctgcttgagcacacacccccaggcagtgccattctctccgtctctgccactgatcgggactcaggtgccaacggtcacatttcctaccacctggcttcccctgccgatggcttcagtgttgaccccaacaatgggaccctgttcacaatagtgggaacagtggccttgggccatgacgggtcaggagcagtggatgtggtgctggaagcacgagaccacggggctccaggccgggcagcacgagccacagtgcacgtgcagctgcaggaccagaacgaccacgccccgagcttcacattgtcacactaccgtgtggctgtgactgaagacctgccccctggctccactctgctcaccctggaggctacagatgctgatggaagccgcagccatgccgctgtggactacagcatcatcagtggcaactggggccgagtcttccagctggaacccaggctggctgaggctggggagagtgctggaccaggcccccgggcactgggctgcctggtgttgcttgaacctctagactttgaaagcctgacacagtacaatctaacagtggctgcagctgaccgtgggcagccaccccaaagctcagtcgtgccagtcactgtcactgtactagatgtcaatgacaacccacctgtctttacccgagcatcctaccgtgtgacagtacctgaggacacacctgttggagctgagctgctgcatgtagaggcctctgacgctgaccctggccctcatggcctcgtgcgtttcactgtcagctcaggcgacccatcagggctctttgagctggatgagagctcaggcaccttgcgactggcccatgccctggactgtgagacccaggctcgacatcagcttgtagtacaggctgctgaccctgctggtgcacactttgctttggcaccagtgacaattgaggtccaggatgtgaatgatcatggcccagccttcccactgaacttactcagcaccagcgtggccgagaatcagcctccaggcactctcgtgaccactctgcatgcaatcgacggggatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagctcggccatgtcccccagctccccgtatcgacccaccacccctcatcactgccgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatccagtctccagctttgttctatagggatgactggaagacacctggcagagtattgtggatacctcaggaggcacagaggggtggtggggtggggatggcactgggagctcaggagcctagcctgaggctgatgatcacatctctctgcagctattcttttccctctaatatgggcaaagaggccagcagggcc

SEQ ID NO: 736330 - DNA, 3889 bp, Homo sapiens
cgggaggtggacgacctggagcagtgtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattgctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagcgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatccagtctccagctttgttctatagggatgactggaagacacctggcagagtattgtggatacctcaggaggcacagaggggtggtggggtggggatggcactgggagctcaggagcctagcctgaggctgatgatcacatctctctgcagctattcttttccctctaatatgggcaaagaggccagcagggcc

SEQ ID NO: 736331 - DNA, 8629 bp, Homo sapiens
  misc_feature (106)..(106): n is a, c, g, or t
  misc_feature (147)..(147): n is a, c, g, or t
  misc_feature (174)..(174): n is a, c, g, or t
  misc_feature (179)..(181): n is a, c, g, or t
  misc_feature (186)..(186): n is a, c, g, or t
  misc_feature (200)..(201): n is a, c, g, or t
gcggggggaggggaggggaggggagggggcgcggggccgcggcagcggagctcgcatcctcggcggggcggctgtgcaggaggcggcgcccgggctcagcgacgancgatcgacgccaaggcgcgcgaccgacgcggctgccggagngatcgcggcctcgagacacgactgcgnacgannngcgcncaggcccgcgcganngcgctccgggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggccttggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtaccagaccgcgtgcctccaggaacactggtgacgactctgcaggcgaaggatccagatgagggggagaatgggaccatcttgtacacgctaactggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgctcacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattgctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgccaacgacaatgctccccgtttcctgcggccccattatgtggccttccttcctgagtcccggcccttggaggggcccctgctgcaggtggaggcggatgacctggatcaaggctctggaggacagatttcctacagtctggctgcatcccagccggcacgtggattgttccacgtagacccaaccacaggcactatcactaccacagccatcctggaccgtgagatctgggctgaaacacggttggtgctgatggccacagacagagggagcccagccctggtgggctcagctaccttgacggtgatggtcatcgacaccaatgacaatcgccccaccatcccccaaccctgggagctccgagtgtcagaagatgcgttattgggctcagagattgcacaggtaacagggaatgatgtggactcaggacccgtgctgtggtatgtgctaagcccatctgggccccaggatcccttcagtgttggccgctatggaggccgtgtctccctcacggggcccctggactttgagcagtgtgaccgctaccagctgcagctgctggcacatgatgggcctcatgagggccgtgccaacctcacagtgcttgtggaggatgtcaatgacaatgcacctgccttctcacagagcctctaccaggtaatgctgcttgagcacacacccccaggcagtgccattctctccgtctctgccactgatcgggactcaggtgccaacggtcacatttcctaccacctggcttcccctgccgatggcttcagtgttgaccccaacaatgggaccctgttcacaatagtgggaacagtggccttgggccatgacgggtcaggagcagtggatgtggtgctggaagcacgagaccacggggctccaggccgggcagcacgagccacagtgcacgtgcagctgcaggaccagaacgaccacgccccgagcttcacattgtcacactaccgtgtggctgtgactgaagacctgccccctggctccactctgctcaccctggaggctacagatgctgatggaagccgcagccatgccgctgtggactacagcatcatcagtggcaactggggccgagtcttccagctggaacccaggctggctgaggctggggagagtgctggaccaggcccccgggcactgggctgcctggtgttgcttgaacctctagactttgaaagcctgacacagtacaatctaacagtggctgcagctgaccgtgggcagccaccccaaagctcagtcgtgccagtcactgtcactgtactagatgtcaatgacaacccacctgtctttacccgagcatcctaccgtgtgacagtacctgaggacacacctgttggagctgagctgctgcatgtagaggcctctgacgctgaccctggccctcatggcctcgtgcgtttcactgtcagctcaggcgacccatcagggctctttgagctggatgagagctcaggcaccttgcgactggcccatgccctggactgtgagacccaggctcgacatcagcttgtagtacaggctgctgaccctgctggtgcacactttgctttggcaccagtgacaattgaggtccaggatgtgaatgatcatggcccagccttcccactgaacttactcagcaccagcgtggccgagaatcagcctccaggcactctcgtgaccactctgcatgcaatcgacggggatgctggggcttttgggaggctccgttacagcctgttggaggctgggccaggacctgagggccgtgaggcatttgcactgaacagctcaacaggggagttgcgtgcgcgagtgccctttgactatgagcacacattatggagggatcctcaatcaccca

SEQ ID NO: 736332 - DNA, 8806 bp, Homo sapiens
  misc_feature (106)..(106): n is a, c, g, or t
  misc_feature (147)..(147): n is a, c, g, or t
  misc_feature (174)..(174): n is a, c, g, or t
  misc_feature (179)..(181): n is a, c, g, or t
  misc_feature (186)..(186): n is a, c, g, or t
  misc_feature (200)..(201): n is a, c, g, or t
gcggggggaggggaggggaggggagggggcgcggggccgcggcagcggagctcgcatcctcggcggggcggctgtgcaggaggcggcgcccgggctcagcgacgancgatcgacgccaaggcgcgcgaccgacgcggctgccggagngatcgcggcctcgagacacgactgcgnacgannngcgcncaggcccgcgcganngcgctccgggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggccttggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtaccagaccgcgtgcctccaggaacactggtgacgactctgcaggcgaaggatccagatgagggggagaatgggaccatcttgtacacgctaactggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgctcacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattgctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagctcggccatgtcccccagctccccgtatcgacccaccacccctcatcactgccgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggtccaaacatgttggagggaccgtcgacgcggccgcgaat

SEQ ID NO: 736333 - DNA, 8832 bp, Homo sapiens
  misc_feature (106)..(106): n is a, c, g, or t
  misc_feature (147)..(147): n is a, c, g, or t
  misc_feature (174)..(174): n is a, c, g, or t
  misc_feature (179)..(181): n is a, c, g, or t
  misc_feature (186)..(186): n is a, c, g, or t
  misc_feature (200)..(201): n is a, c, g, or t
gcggggggaggggaggggaggggagggggcgcggggccgcggcagcggagctcgcatcctcggcggggcggctgtgcaggaggcggcgcccgggctcagcgacgancgatcgacgccaaggcgcgcgaccgacgcggctgccggagngatcgcggcctcgagacacgactgcgnacgannngcgcncaggcccgcgcganngcgctccgggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggccttggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtaccagaccgcgtgcctccaggaacactggtgacgactctgcaggcgaaggatccagatgagggggagaatgggaccatcttgtacacgctaactggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgctcacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattgctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagctcggccatgtcccccagctccccgtatcgacccaccacccctcatcactgccgtggcccacccaggagccaagtctgtgccccccaagccagcaaacacagctgcagcccgggccatcttcccaccagcttctcaccgctcccccatcagccatgaaggctccctgtcctcagctgccatgtcccccactctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatccagtctccagctttgttctatagggatgactggaagacacctggcagagtattgtggatacctcaggaggcacagaggggtggtggggtggggatggcactgggagctcaggagcctagcctgaggctgatgatcacatctctctgcagctattcttttccctctaatatgggcaaagaggccagcagggcc

SEQ ID NO: 736334 - DNA, 9045 bp, Homo sapiens
  misc_feature (106)..(106): n is a, c, g, or t
  misc_feature (147)..(147): n is a, c, g, or t
  misc_feature (174)..(174): n is a, c, g, or t
  misc_feature (179)..(181): n is a, c, g, or t
  misc_feature (186)..(186): n is a, c, g, or t
  misc_feature (200)..(201): n is a, c, g, or t
gcggggggaggggaggggaggggagggggcgcggggccgcggcagcggagctcgcatcctcggcggggcggctgtgcaggaggcggcgcccgggctcagcgacgancgatcgacgccaaggcgcgcgaccgacgcggctgccggagngatcgcggcctcgagacacgactgcgnacgannngcgcncaggcccgcgcganngcgctccgggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggccttggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtaccagaccgcgtgcctccaggaacactggtgacgactctgcaggcgaaggatccagatgagggggagaatgggaccatcttgtacacgctaactggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgctcacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattgctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagcgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatccagtctccagctttgttctatagggatgactggaagacacctggcagagtattgtggatacctcaggaggcacagaggggtggtggggtggggatggcactgggagctcaggagcctagcctgaggctgatgatcacatctctctgcagctattcttttccctctaatatgggcaaagaggccagcagggcc

SEQ ID NO: 736335 - DNA, 3796 bp, Homo sapiens
  misc_feature (106)..(106): n is a, c, g, or t
  misc_feature (147)..(147): n is a, c, g, or t
  misc_feature (174)..(174): n is a, c, g, or t
  misc_feature (179)..(181): n is a, c, g, or t
  misc_feature (186)..(186): n is a, c, g, or t
  misc_feature (200)..(201): n is a, c, g, or t
gcggggggaggggaggggaggggagggggcgcggggccgcggcagcggagctcgcatcctcggcggggcggctgtgcaggaggcggcgcccgggctcagcgacgancgatcgacgccaaggcgcgcgaccgacgcggctgccggagngatcgcggcctcgagacacgactgcgnacgannngcgcncaggcccgcgcganngcgctccgggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggccttggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactgtgggatcctcagacaagcgggactgtgttcattctggttgaggatg

SEQ ID NO: 736336 - DNA, 4288 bp, Homo sapiens
  misc_feature (106)..(106): n is a, c, g, or t
  misc_feature (147)..(147): n is a, c, g, or t
  misc_feature (174)..(174): n is a, c, g, or t
  misc_feature (179)..(181): n is a, c, g, or t
  misc_feature (186)..(186): n is a, c, g, or t
  misc_feature (200)..(201): n is a, c, g, or t
gcggggggaggggaggggaggggagggggcgcggggccgcggcagcggagctcgcatcctcggcggggcggctgtgcaggaggcggcgcccgggctcagcgacgancgatcgacgccaaggcgcgcgaccgacgcggctgccggagngatcgcggcctcgagacacgactgcgnacgannngcgcncaggcccgcgcganngcgctccgggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggccttggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacaggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatccagtctccagctttgttctatagggatgactggaagacacctggcagagtattgtggatacctcaggaggcacagaggggtggtggggtggggatggcactgggagctcaggagcctagcctgaggctgatgatcacatctctctgcagctattcttttccctctaatatgggcaaagaggccagcagggcc

SEQ ID NO: 736337 - DNA, 1396 bp, Homo sapiens
  misc_feature (1387)..(1388): n is a, c, g, or t
  misc_feature (1390)..(1390): n is a, c, g, or t
  misc_feature (1392)..(1395): n is a, c, g, or t
aaggcagtattgaccagacatttctatttcagagttggatttgtgcttagttttttttaggtgttgggacccttgtagttgctttttattttgcttagtcaacaaacactaaaatgataaaatttggtatgtataagtactggacgaaggatgttttgacactaaaaaggacataatttaggaaattaagaatttagacaccaagtttggcttaatagaaaaagtcactatctgaacttctttctttttcaccacaaatcaccgcagaccagtgtttgggagcaggtgtaggaaattgaattattggatctatgtttaggtaagaaaactaaaggtacttcagaatttaggctatgacataactgtctttctgaagtttaaagaaagaaagtgaactatagaaatctattcagctaattaaagtgaatgaaaaatattacagattccataactgcatggcgccttacctgctattaatactgccgccttactgtcagccagatgattttttcccaccacggccagtcttaaatttggcaataagaaaaagctaatcttccaagtgtaagtaggtatgtgttagaatcttggtgaaagataaacacaagacagtcttcttggcgcaggtcctaacagttggtgagataatacataagatggtttcaggattattgtagaattatttaggttgaaagagactgtaagagactaatgaagcatacccagagaggttgctacagtgactccagtcagttttaggacccaggactcctgaacttcaatttcagtattatttttctgtaccaaactcattcaataaatacttgagattagggataagtttgaagttagaagattccagagtacactcaaatagtatttggcacatagcttgttgatcaaaagtatttactaagtgagtgacaaaaggcactagcaactttaaggattttgcctattagtatcatatggcatgtagctatcaagccagtttcgtttagttattttgtgttgccaagcatatgatacgtggtgtcacactgagcctttgggatcctttccctggatacataaccctagtagataatgttactgcaagatgtaatgaccaaatccaacctactgcaaatgttactatggaaatctcaatgcaaaagtagcctttgtgattttttttttaaaccgtctccataacagaacacttagaattattagccatttgctgcaaagtatttgttttaaaatgtctggcatatacaccactaacatttaaatgcccaacattcggtctatacgtgaaaaaactagaagaaaagccctgttggagttttgatgtagagtgcaataatacatcaataaaggtattttaaaatgaaaaaaaaaatcnntngnnnng

SEQ ID NO: 736338 - DNA, 1137 bp, Homo sapiens; identical to SEQ ID NO: 27160

SEQ ID NO: 736339 - DNA, 4293 bp, Homo sapiens
cgcaccccggcaagcagcagcgggccgcgacgcccagcctgccagtgagctgcgacgggcacaccccggagcgtcggcgactgcggacaggttagagtgggggcaggggcgggcgcgggagcagcccagggccagagagggagcccgagccaggccatctccaaccatgtccgacgaggcctcggccatcacttcctacgagaagtttctaacccccgaggagcccttcccactcctgggacctcctcgcggggtgggcacctgcccgagcgaggagccgggctgcctggacatcagcgacttcggctgccagctgtcctcctgccatcgcaccgacccgctccaccgcttccacaccaacaggtggaacctaacttcttgtggaacaagtgttgccagctcagaaggcagtgaggagctgttttcatctgtgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcagttaccaggcagtgacattgccagtgggagtgatgtactttctgatgtcatacccagtattccaagttcaccttgcctgcttcctaaaaagaaaaacaagcaccggaatttagatgaactcccttggagtgcaatgacaaatgatgagcaggtggaatatattgagtatctgagtcggaaagtgagtactgagatgggtcttcgggagcaacttgatattattaagatcattgatccttctgctcaaatctcccctacagacagtgagtttattattgaacttaactgtctcacagatgaaaaactgaagcaggtcagaaactatatcaaggaacatagccctcgccaacggcctgcaagagaggcctggaagagaagcaactttagttgtgcaagcaccagtggagtgagcggtgccagtgccagcgccagcagcagcagtgccagcatggtcagttctgcaagcagcagtgggtccagtgttggaaactctgcttcaaactccagtgccaacatgagtcgagcacacagtgacagcaacctgtctgcaagtgcagcagagcggattcgggattcaaaaaagcgatccaagcagcggaagttacagcagaaggccttccgcaagaggcagctgaaggagcagaggcaggcccggaaggagaggctcagtgggctcttccttaacgaagaggtgctgtccttgaaagtgactgaggaagaccatgaagcagatgttgatgttttgatgtaataagggtgaatttatcaacgttctttgtgagcattaaaatactccatccttatgggtttacatgcatcttgaccaaaattttggttagggctgtgctgatgtaccattaataatttaagccagtggttcttggcaggtgatcccaagacctgcagcttcagcatcacttgagaagttgttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcgtcttcaaagactagtacttacacagtttagaagatttcaaggtactgctgacagtagtttattatgtcagtatacatacatgtgtagagatcataatttagttcccttcttaatgttacaatttcttagtttacttttcctaaagggccatagcataattcttgattcctggtggaaatcttttctgaggtgtgggggtgggcaaggtgtggattgctgtttacgatagtgccttcattagttttagttctgtctgttttcattcattattgactcaaaggtattagaacaggcccttatctttttcctattagatttatttttgttttttactttatgtaagttcagaatccttttttaagtgatgactactgatgaaataatgttactagtagctgaattttagacttgatgctatgttgattaatatttaaatggtgaaagtaattaggcaaaataagcaattctgcttttctgttgctttcagaatttttaggctgtaaaattgtctcaggcaggaagtcagtctatatctctctcaagttcttattgtaggtcatttttttttcagcacagctctaatttttaaatatttggtataacagcttctggcatgtgacctagttaatgttgaaaattaactgatgaaaacccttgtagatctgctaaacttctctataaattgctagaaatatacagagcaatgagatatagaaaacaccttagcttgttggttattaatagagctctaattttaactgtgaaatcatggagtttctttaaatgttttcctagagtgtttgttatcatgaacattagaaatagcattattccttttcttctaccacatgtcttgaacattcacatgggttaaagaagatggaaactgatactactgacaatcaagctgctttctgactttcataattttctttatattgtggatagcattttgaaggtgaccgtgattctgtaggaagagctgtaatcaatatttttcaaactctaagagtacagaggttagtaagatttcttttttttttactttttgttacgtcaagtagcttattaagaaaaagattcatgacttaaattcttaattctcagttgatacaaaggcttataatcatgtgttttaaaattttgatttcattttcgttccttgaaggttaaagaatggaaactggggataaaaattaatacactgcagctttgccaaggtctgtgatatggttgtaaccttttaaagactactaaagtcataatttgaaatttttactaaaataaaacatatgtgtctatggttttcaattggagtagtctttcttactttcccccttcccctctttggttctcctaaccagcttagaggacccaaagagagcttagggatagacaccagaatactctgtggaggtggaacaacttaacctcactgttttcccttccaagtataggaagagcaaatagagcatagtaactgtatctaaattctctacctgctcttagcaaaagcaaaatcccacagaatgattgcctgctgtctttacctattcttcaaggaaaacaggccacttttggagaccatagagcaccatttatctgtcaaatacttggaaactatttacttaacggtcatcagtaaaaaaccctaaacaaggtcatgatataatttaagaccaattcccctactctcccaataatcacatagtcttattactttcaatttaacttgagtcactattaagcaagtttaccaaagtgccacaaagttgatttttaacgtttgtaaaggtttgaatgtttatagaagtgcatcatgaaattttgtgtaaatccagatgaactgtcattatagtactataaattagagatagtccataaagttgggttgaaggagattgaaaatatttcctttgattaaaagaaaataattaactaacttgggcttgcttgtgattgaagagggagattagatagtcctctgtccccccaaaaaagaaactagcagagaaagacataaaaagctctttggtgtctgttcatgtgctgtacattttttccgttttaatgtcttgtgtagataattcaaagtttgaactatttctttcttggaataagtaataatttattcaatatggtgtatctctgagttcaatttaaaacaatccaactcagtaatatttatttttaaatacaaatcctaactaaccaattaattaataaaaaggcaagacttacttgctgtagtattggttctcatctgtagagaactgacattggagcaaattttaagtctcccctttgaaaataagccttgttaactgagggcgtaatacatttcccacagattttatccagaaacattttattagagatcttatagtagtatctcagttcctactacagctttctaaaggatgagacttgcatttaacaaaatgacatatataatatttttctatagttttgcaactgaattaaaggaaggtgatgtattataatgtgtagtgaggtataaagggctagttcattctctcccaacaagaacttagaataaaataacacttttttttcatgagacttacctcatttttgttagg

SEQ ID NO: 736340 - DNA, 4062 bp, Homo sapiens
  misc_feature (4058)..(4058): n is a, c, g, or t
cgcaccccggcaagcagcagcgggccgcgacgcccagcctgccagtgagctgcgacgggcacaccccggagcgtcggcgactgcggacaggttagagtgggggcaggggcgggcgcgggagcagcccagggccagagagggagcccgagccaggccatctccaaccatgtccgacgaggcctcggccatcacttcctacgagaagtttctaacccccgaggagcccttcccactcctgggacctcctcgcggggtgggcacctgcccgagcgaggagccgggctgcctggacatcagcgacttcggctgccagctgtcctcctgccatcgcaccgacccgctccaccgcttccacaccaacaggtggaacctaacttcttgtggaacaagtgttgccagctcagaaggcagtgaggagctgttttcatctgtgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcagttaccaggcagtgacattgccagtgggagtgatgtactttctgatgtcatacccagtattccaagttcaccttgcctgcttcctaaaaagaaaaacaagcaccggaatttagatgaactcccttggagtgcaatgacaaatgatgagcaggtggaatatattgagtatctgagtcggaaagtgagtactgagatgggtcttcgggagcaacttgatattattaagatcattgatccttctgctcaaatctcccctacagacagtgagtttattattgaacttaactgtctcacagatgaaaaactgaagcaggtcagaaactatatcaaggaacatagccctcgccaacggcctgcaagagaggcctggaagagaagcaactttagttgtgcaagcaccagtggagtgagcggtgccagtgccagcgccagcagcagcagtgccagcatggtcagttctgcaagcagcagtgggtccagtgttggaaactctgcttcaaactccagtgccaacatgagtcgagcacacagtgacagcaacctgtctgcaagtgcagcagagcggattcgggattcaaaaaagcgatccaagcagcggaagttacagcagaaggccttccgcaagaggcagctgaaggagcagaggcaggcccggaaggagaggctcagtgggctcttccttaacgaagaggtgctgtccttgaaagtgactgaggaagaccatgaagcagatgttgatgttttgatgtaataagggtgaatttatcaacgttctttgtgagcattaaaatactccatccttatgggtttacatgcatcttgaccaaaattttggttagggctgtgctgatgtaccattaataatttaagccagtggttcttggcaggtgatcccaagacctgcagcttcagcatcacttgagaagttgttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcgtcttcaaagactagtacttacacagtttagaagatttcaaggtactgctgacagtagtttattatgtcagtatacatacatgtgtagagatcataatttagttcccttcttaatgttacaatttcttagtttacttttcctaaagggccatagcataattcttgattcctggtggaaatcttttctgaggtgtgggggtgggcaaggtgtggattgctgtttacgatagtgccttcattagttttagttctgtctgttttcattcattattgactcaaaggtattagaacaggcccttatctttttcctattagatttatttttgttttttactttatgtaagttcagaatccttttttaagtgatgactactgatgaaataatgttactagtagctgaattttagacttgatgctatgttgattaatatttaaatggtgaaagtaattaggcaaaataagcaattctgcttttctgttgctttcagaatttttaggctgtaaaattgtctcaggcaggaagtcagtctatatctctctcaagttcttattgtaggtcatttttttttcagcacagctctaatttttaaatatttggtataacagcttctggcatgtgacctagttaatgttgaaaattaactgatgaaaacccttgtagatctgctaaacttctctataaattgctagaaatatacagagcaatgagatatagaaaacaccttagcttgttggttattaatagagctctaattttaactgtgaaatcatggagtttctttaaatgttttcctagagtgtttgttatcatgaacattagaaatagcattattccttttcttctaccacatgtcttgaacattcacatgggttaaagaagatggaaactgatactactgacaatcaagctgctttctgactttcataattttctttatattgtggatagcattttgaaggtgaccgtgattctgtaggaagagctgtaatcaatatttttcaaactctaagagtacagaggttagtaagatttcttttttttttactttttgttacgtcaagtagcttattaagaaaaagattcatgacttaaattcttaattctcagttgatacaaaggcttataatcatgtgttttaaaattttgatttcattttcgttccttgaaggttaaagaatggaaactggggataaaaattaatacactgcagctttgccaaggtctgtgatatggttgtaaccttttaaagactactaaagtcataatttgaaatttttactaaaataaaacatatgtgtctatggttttcaattggagtagtctttcttactttcccccttcccctctttggttctcctaaccagcttagaggacccaaagagagcttagggatagacaccagaatactctgtggaggtggaacaacttaacctcactgttttcccttccaagtataggaagagcaaatagagcatagtaactgtatctaaattctctacctgctcttagcaaaagcaaaatcccacagaatgattgcctgctgtctttacctattcttcaaggaaaacaggccacttttggagaccatagagcaccatttatctgtcaaatacttggaaactatttacttaacggtcatcagtaaaaaaccctaaacaaggtcatgatataatttaagaccaattcccctactctcccaataatcacatagtcttattactttcaatttaacttgagtcactattaagcaagtttaccaaagtgccacaaagttgatttttaacgtttgtaaaggtttgaatgtttatagaagtgcatcatgaaattttgtgtaaatccagatgaactgtcattatagtactataaattagagatagtccataaagttgggttgaaggagattgaaaatatttcctttgattaaaagaaaataattaactaacttgggcttgcttgtgattgaagagggagattagatagtcctctgtccccccaaaaaagaaactagcagagaaagacataaaaagctctttggtgtctgttcatgtgctgtacattttttccgttttaatgtcttgtgtagataattcaaagtttgaactatttctttcttggaataagtaataatttattcaatatggtgtatctctgagttcaatttaaaacaatccaactcagtaatatttatttttaaatacaaatcctaactaaccaattaattaataaaaaggcaagacttacttgctgtagtattggttctcatctgtagagaactgacattggagcaaattttaagtctcccctttgaaaataagccttgttaactgagggcgtaatacatttcccacttcagattggtaacacctcngtgc

SEQ ID NO: 736341 - DNA, 4164 bp, Homo sapiens
cgcaccccggcaagcagcagcgggccgcgacgcccagcctgccagtgagctgcgacgggcacaccccggagcgtcggcgactgcggacaggttagagtgggggcaggggcgggcgcgggagcagcccagggccagagagggagcccgagccaggccatctccaaccatgtccgacgaggcctcggccatcacttcctacgagaagtttctaacccccgaggagcccttcccactcctgggacctcctcgcggggtgggcacctgcccgagcgaggagccgggctgcctggacatcagcgacttcggctgccagctgtcctcctgccatcgcaccgacccgctccaccgcttccacaccaacaggtggaacctaacttcttgtggaacaagtgttgccagctcagaaggcagtgaggagctgttttcatctgtgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcagttaccaggcagtgacattgccagtgggagtgatgtactttctgatgtcatacccagtattccaagttcaccttgcctgcttcctaaaaagaaaaacaagcaccggaatttagatgaactcccttggagtgcaatgacaaatgatgagcaggtggaatatattgagtatctgagtcggaaagtgagtactgagatgggtcttcgggagcaacttgatattattaagatcattgatccttctgctcaaatctcccctacagacagtgagtttattattgaacttaactgtctcacagatgaaaaactgaagcaggtcagaaactatatcaaggaacatagccctcgccaacggcctgcaagagaggcctggaagagaagcaactttagttgtgcaagcaccagtggagtgagcggtgccagtgccagcgccagcagcagcagtgccagcatgaagcgatccaagcagcggaagttacagcagaaggccttccgcaagaggcagctgaaggagcagaggcaggcccggaaggagaggctcagtgggctcttccttaacgaagaggtgctgtccttgaaagtgactgaggaagaccatgaagcagatgttgatgttttgatgtaataagggtgaatttatcaacgttctttgtgagcattaaaatactccatccttatgggtttacatgcatcttgaccaaaattttggttagggctgtgctgatgtaccattaataatttaagccagtggttcttggcaggtgatcccaagacctgcagcttcagcatcacttgagaagttgttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcgtcttcaaagactagtacttacacagtttagaagatttcaaggtactgctgacagtagtttattatgtcagtatacatacatgtgtagagatcataatttagttcccttcttaatgttacaatttcttagtttacttttcctaaagggccatagcataattcttgattcctggtggaaatcttttctgaggtgtgggggtgggcaaggtgtggattgctgtttacgatagtgccttcattagttttagttctgtctgttttcattcattattgactcaaaggtattagaacaggcccttatctttttcctattagatttatttttgttttttactttatgtaagttcagaatccttttttaagtgatgactactgatgaaataatgttactagtagctgaattttagacttgatgctatgttgattaatatttaaatggtgaaagtaattaggcaaaataagcaattctgcttttctgttgctttcagaatttttaggctgtaaaattgtctcaggcaggaagtcagtctatatctctctcaagttcttattgtaggtcatttttttttcagcacagctctaatttttaaatatttggtataacagcttctggcatgtgacctagttaatgttgaaaattaactgatgaaaacccttgtagatctgctaaacttctctataaattgctagaaatatacagagcaatgagatatagaaaacaccttagcttgttggttattaatagagctctaattttaactgtgaaatcatggagtttctttaaatgttttcctagagtgtttgttatcatgaacattagaaatagcattattccttttcttctaccacatgtcttgaacattcacatgggttaaagaagatggaaactgatactactgacaatcaagctgctttctgactttcataattttctttatattgtggatagcattttgaaggtgaccgtgattctgtaggaagagctgtaatcaatatttttcaaactctaagagtacagaggttagtaagatttcttttttttttactttttgttacgtcaagtagcttattaagaaaaagattcatgacttaaattcttaattctcagttgatacaaaggcttataatcatgtgttttaaaattttgatttcattttcgttccttgaaggttaaagaatggaaactggggataaaaattaatacactgcagctttgccaaggtctgtgatatggttgtaaccttttaaagactactaaagtcataatttgaaatttttactaaaataaaacatatgtgtctatggttttcaattggagtagtctttcttactttcccccttcccctctttggttctcctaaccagcttagaggacccaaagagagcttagggatagacaccagaatactctgtggaggtggaacaacttaacctcactgttttcccttccaagtataggaagagcaaatagagcatagtaactgtatctaaattctctacctgctcttagcaaaagcaaaatcccacagaatgattgcctgctgtctttacctattcttcaaggaaaacaggccacttttggagaccatagagcaccatttatctgtcaaatacttggaaactatttacttaacggtcatcagtaaaaaaccctaaacaaggtcatgatataatttaagaccaattcccctactctcccaataatcacatagtcttattactttcaatttaacttgagtcactattaagcaagtttaccaaagtgccacaaagttgatttttaacgtttgtaaaggtttgaatgtttatagaagtgcatcatgaaattttgtgtaaatccagatgaactgtcattatagtactataaattagagatagtccataaagttgggttgaaggagattgaaaatatttcctttgattaaaagaaaataattaactaacttgggcttgcttgtgattgaagagggagattagatagtcctctgtccccccaaaaaagaaactagcagagaaagacataaaaagctctttggtgtctgttcatgtgctgtacattttttccgttttaatgtcttgtgtagataattcaaagtttgaactatttctttcttggaataagtaataatttattcaatatggtgtatctctgagttcaatttaaaacaatccaactcagtaatatttatttttaaatacaaatcctaactaaccaattaattaataaaaaggcaagacttacttgctgtagtattggttctcatctgtagagaactgacattggagcaaattttaagtctcccctttgaaaataagccttgttaactgagggcgtaatacatttcccacagattttatccagaaacattttattagagatcttatagtagtatctcagttcctactacagctttctaaaggatgagacttgcatttaacaaaatgacatatataatatttttctatagttttgcaactgaattaaaggaaggtgatgtattataatgtgtagtgaggtataaagggctagttcattctctcccaacaagaacttagaataaaataacacttttttttcatgagacttacctcatttttgttagg

SEQ ID NO: 736342 - DNA, 635 bp, Homo sapiens
gctttttttttttatttgcaatctttcttccccgcatttagtcacctttcacgtttaagtatttattcttttatttatgaacctcagaaagattgcaaataaatacatgggccaaagatgtttggtttgcccatggagttttaattaaaaaaattaataaggaaaacaaatacccaaaataaggaagactgacaaatgagtgagtggatgagagagtgaatggtgcttgacgtaggagcagtagtgctttagggaccagcatgaaggtggtgaccgggagccctgattcatgggattctgtccacctgactttataagaaccaagaatggctgggaatggtggctcacgcctgtaatcccagcactttgggaggccgaggtgggcggatcatgaggtcaggagtttgagaccagccagtttgagatcagcctggccaacatggtgaaattccatctctactaaaaaaatacaaaaattatgggcgtggtggcacctgtctgtaatcctagctactcgggaggctgagagaggagaattgcttgaacccgggaggtggaggttgtagtgagccaagattgcaccactgcactccagcctgggctacagagcaagacactatcttagatcaaaaaag

SEQ ID NO: 736343 - DNA, 412 bp, Homo sapiens; identical to SEQ ID NO: 366299

SEQ ID NO: 736344 - DNA, 452 bp, Homo sapiens
gattgctcctgaaagtgagcatggtaaaaagggggttggacagacatggctgggttctctcctgtaccacgcactggtttagccacagctggtgacagtggagggaaaattggtcctactttttcagatatctcaacttggaacaatttacttgggcttcagaaataaagactcattaatacatttgcctaaaacacacttactcaatgtctactatgtcctggcactgtgctaagcgccagggaaccaacaaagaacaagatacataaggcccctgcccacaacggggcttaatgacagaaagaaagagggagtggtggaaagaaacaataggatgggaaaaaatgaaaatagaaaaaaggaagtgaaagagataataaataattagatcaaataagttgatgaaaggggatgacacacgaaggggaactgacacgcgaagggggatgaca

SEQ ID NO: 736345 - DNA, 270 bp, Homo sapiens
aagggaatccgtgctggtgctaagggaattcgtgctggtgcttcgtgctggtgctaagggaattcgtgctggtgcttcgtgctggtgctaagggaattcgtgtgtgccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgacaccagccaattcccggccg

SEQ ID NO: 736346 - DNA, 372 bp, Homo sapiens
  misc_feature (346)..(346): n is a, c, g, or t
ggctcgccgagcaataccttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagagcngttgagccttcagtattgctcggcga

SEQ ID NO: 736347 - DNA, 348 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacggtacttcaaccctcctgctatcatttcataaccaacgtggcgggcagaatctcccaaccccaccaccatccttgcaccacccccagacccactagcaattaaaagacaattttaaattttaa

SEQ ID NO: 736348 - DNA, 8184 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagcccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaaaaaaaaaaaaaaaaaaaaaaaaaaaaaaaaaaaaaaaaaaaaaaaaaaaaaaaaaaaaaaaaaaaaaaaaacaaaaaaaaatataacataaaagaaaaaaaaataataaacaaccaaaaatctaaaataaaaccgtggccctttttttaaaaaccatgctaaagggaaaacccttgccgtgccccaatttaaccgtttgggagaaatccccttttcgcggggggttattttcaaagggcccctcgcaaacccttgtcaaacagtccaaaccctgatggcaaaggcaattttacgctttattttttgtaaaatcccttaaattttggccaaaaacctgttttttacccaataggccaaatgcctaaatccctttaaattaaagaaattccccgaataggttggacttctccacatttgaaccaaagtcccttttaaaaaagggcttcaactgcaagggggctcgttttagggctgtgcgcctttggaaccatccccttataaatattgaggtcaggggcacaggattatattgcaccctgggacctcctttttctcct

SEQ ID NO: 736349 - DNA, 7999 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagcccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaggacaaagacggccataaagacgaaagagacagacagtgcagaataaaattcgagaagcgttccgcgagcctgagtaagatggagatggctatattattgctgtagaacgtcgcaatgtgaaacccaggcggggggaccgggtaccgatgacgaaaacgtggagatgatcacggtaacgggtcgtgccttaaaaggtatgggcacgataaccaggtggtaccaccgatcaaagcactgtgaagaccatcgcctctatcgcgatgggcgggaatgatcaacagttgctcaccctgagcatttcttgttcttcttcggggagagaattcaggggctcgcatttacgggaaccgagaacctgttcctttatttccc

SEQ ID NO: 736350 - DNA, 7873 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagcccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaaaaagcatataacaacaattagaaatgacgaatcgtcgctgcgtcactaaatgacagaggcgcaagagacatagatatacgaccgctcgcactactacacagggggaccagggagacgtactatcgacgctaccgcccgccgaccgcgcgagggagagacgcgaccgcacgacacagcatcagcctaagccttcgagacgcgaccgaagaagagagaagagaagaaacgcagacaggaagaggcgcc

SEQ ID NO: 736351 - DNA, 8041 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagcccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaaaaaaaaaaaaaaaaaaaaaaaaaaaaaaaaaaaaaaaaaaaaaaactagagggggggcccgctccccaatgggccctatagagagtcagttcacaatcaattgagtcgccttcaacaaccgtgggactggaaaaaccctgcctgcacccaactaaattgcttggcagcaaatacacctttctgcagctggcttattaactagcaggccggcacggatcgaacttcctaacaatggcgtcacctgcatgggtgaacggcaggttggttggcgggaatacttatgttaaagccaaatcccctcataaattaatagaatgatccgacatagggtggactggtgttccattctggaccatcaatccattattaaggacggagctttcaaccacgaagggggaaacacctctgtttggg

SEQ ID NO: 736352 - DNA, 7945 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagcccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaaaaaaattcactggccgtcgttttacaacgtcgtgactgggaaaaccctggggttacccaacttaatcgccttgcagcacatccccctttcgccagctggcgtaaagcgaagaaggcgcacgaatggcttcccagcgttgcgcgctgaatgggacggccactgtagcgtaaatttgtcaatcccgttcctttggtaacacgccttttaccatgcccacgggcatcctttattggccaacgggtgtttcccgggacagcccatggcccccacgggaccatagtccccataaccccaattggggcggcacccccttttggg

SEQ ID NO: 736353 - DNA, 7981 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagcccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaagtcatgagacttaataagatctctatcaagaaaaaaactgcaaggtggggcccgtgacccagttcgccctatagtgagtcgcattacaattaactgcccggcggttatacacgtcccgactgggaaatccgtggggggacccaacttactcttctcgcaaaaaagtgcccctttccccagctggggccctagtttatgaggccccgaccgggggaaatcctcagcgggcgcacattttgagcggctaatggcaaacgcgatgcgttaatggtgagcaaaaaatggggctcaatcttgggggcatttccaattgtttgacccaactaggcggaaatcgggcaaactgctttggtag

SEQ ID NO: 736354 - DNA, 12025 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagcccatcacctggatgcctacgtgggaagggacctcgaatgtgggaccccagcccctctccagctcgaaatcggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaacccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaaggccaaaaagtctacattgcgtgtgtggatggatgaatgagcagtgggagtgcagcgccaggtgacaagatgttgtgaggggttttgagtcatccagtcctgggcactgaggtctgttagatgaaaggatatgagaaaggtaatattggtaaataaagaaataggaaacaatgtaacaaatgttaagtacagaaatacattaatgggtggtaaataaagatgtaaaagaaggcaatgcgatcgatggtggcaaaagatcatcacagattaagggctatggctggtccacttctagaaaaccacaggctgtccattaaataatgaacatctaagtgaacaagtcagtgagtacctaaatagacaaggatgaggtgaatgagaagacatggccccatgggtcctcctgatgagggtgttggggtcccccctgggcaccccagctgcatgaaaatgaaggacaggaggtatggaaagctatgacagaagagagaaaggaacggtaaaaagaaataacaaccaaatggataaatgggtagatccacgagaagagttaggctaggacttgtcataagggcacctgactccactaatagaggaataaatgcctaataaaaagagagcaagcaggaaggaaggatgctatgaatgcaggaaggaagtaatgagtgagacgtggaaccgcacggccaaggatggacgtttgcgggtggctttttgatgcgtacagccaagccactccatggcaatgagctccgaagacaaagtgcaagagagaatgagtgagagagtgagagagagagaaacaataaaaaatgggaagaaatgtaaaaaggaagaaaggaagagaggtaatatattaaggaataaatacatgcatgcagatttaagacagagccatgctagaacaggaatgaaaggctgtgtgaaccaagcagaccgcttaattggcaccagtgctgctggtatggtcaatcacctactcaactaaggaacggctcaaagcatacacatgggagggaggagtggggccacagagagagggcccattagttgcagattacgatgtatccagttaggtgcacctgccttcgagaagtgtaaaaataagtatttacatagaaagaaagactgaatggatgcacggtgaatgcatgaatgattgaacgacagaaaagatttgcattgaccgatgaggagggcattgtagacagggatgagggtcattgatcctgggtgcagatctccaaaagaatgacagaaagaaagagggagtggtggaaagaaacaataggatgggaaaaaatgaaaatagaaaaaaggaagtgaaagagataataaataattagatcaaataagttgatgaaaggggactggtttagcacaagccatccacattaattcaaacctgtggctctgaagtttgttttttaaatgaccacaagtgtaagactgaatgaaagaataaatgcgtgcattccataggatgcaagaaaaggagtgaggaatgggaaaattggaagaacgagagagggagagatgtaagaaaagaaaggaaaagtgaagtaggcatatgaaagaaaaggcacttcttggacaagcactgaaatataatgagacagttttacccattaaatataataaacagtaaacgttgaggttcatcaataaaagcacagatacctgaatagaggagtgacctgaatagaattcgttcagccgaacgaatgagaatggatgattttcactatcctgtgcactcaaggcccaaaagagaaagcaagagaggagagaatatggaaacgtatgacaggatgtatataagcaatacaaacatattgaatgaataaataaagacataaatatgtgggagagtggaccacgcaaggacaaaaagaggagagaaggcagcaagaattatgactaattcaaaactgggttcctgagatagttaaataaatcctgcaccaaatccccagggggagaaattaacaaacaaaagacagccccacacggaccagtgtgcagaaggctccaggaaccgcagattatggttaatccaattctgtgcacctgaggtccataaataaaagaataagtattgaaatgaaagaatgacagaaagaatgaatggacacatgaacgactgaattagaaatggaaatgcctggcacagccaggaaggagctgcccatgggattgtcattcatctcactctgggcacctgaggtccataagcgtgaaaagaggcaggaagagaagtgtcagggagtcaaagatagagctaaggaaaggcaaaaatgaaactaaatgaaagcgaaagggaaaataaagaaaaaccaataaaaaagagaacgaatacgtgggtgtatctgtaagagtaggatctgttaggattagtcataagactgtcagtaatcctgaagatggatgagataatccaggcccaggttcccagggggagggaaaatggagaaaatataaaaagatgtgaaaaaggaaaaaggaaaggtaataaacaaacaaccaaagtgataaatggatagttaagggaggttgtctgaacagggattataattagtttacatacatactccttaaacagataaatacattacacctttcaaagaataaatgaaaaatagagagacatacctggctccaaaacaaggctgtatcttctgccactgtaataaaatagatgcaattgaggttcataaataaaagaataaatacttaaacgtgaaaggtgactaaatgcggggaagaaagattgcaaataaatacatgggccaaagatgtttggtttgcccatggagttttaattaaaaaaattaataaggaaaacaaatacccaaaataaggaagactgacaaatgagtgagtggatgagagagtgaatggtgcttgacgtaggagcagtagtgctttagggaccagcatgaaggtggtgaccgggagccctgattcatgggattctgtccacctgactttataagaaccaagaatggctgggaatggtggctcacgcctgtaatcccagcactttgggaggccgaggtgggcggatcatgaggtcaggagtttgagaccagccagtttgagatcagcctggccaacatggtgaaattccatctctactaaaaaaatacaaaaattatgggcgtggtggcacctgtctgtaatcctagctactcgggaggctgagagaggagaattgcttgaacccgggaggtggaggttgtagtgagccaagattgcaccactgcactccagcctgggctacagagcaagacactatcttagatcaaaaaag

SEQ ID NO: 736355 - DNA, 11501 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagcccatcacctggatgcctacgtgggaagggacctcgaatgtgggaccccagcccctctccagctcgaaatcggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaacccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaaggccaaaaagtctacattgcgtgtgtggatggatgaatgagcagtgggagtgcagcgccaggtgacaagatgttgtgaggggttttgagtcatccagtcctgggcactgaggtctgttagatgaaaggatatgagaaaggtaatattggtaaataaagaaataggaaacaatgtaacaaatgttaagtacagaaatacattaatgggtggtaaataaagatgtaaaagaaggcaatgcgatcgatggtggcaaaagatcatcacagattaagggctatggctggtccacttctagaaaaccacaggctgtccattaaataatgaacatctaagtgaacaagtcagtgagtacctaaatagacaaggatgaggtgaatgagaagacatggccccatgggtcctcctgatgagggtgttggggtcccccctgggcaccccagctgcatgaaaatgaaggacaggaggtatggaaagctatgacagaagagagaaaggaacggtaaaaagaaataacaaccaaatggataaatgggtagatccacgagaagagttaggctaggacttgtcataagggcacctgactccactaatagaggaataaatgcctaataaaaagagagcaagcaggaaggaaggatgctatgaatgcaggaaggaagtaatgagtgagacgtggaaccgcacggccaaggatggacgtttgcgggtggctttttgatgcgtacagccaagccactccatggcaatgagctccgaagacaaagtgcaagagagaatgagtgagagagtgagagagagagaaacaataaaaaatgggaagaaatgtaaaaaggaagaaaggaagagaggtaatatattaaggaataaatacatgcatgcagatttaagacagagccatgctagaacaggaatgaaaggctgtgtgaaccaagcagaccgcttaattggcaccagtgctgctggtatggtcaatcacctactcaactaaggaacggctcaaagcatacacatgggagggaggagtggggccacagagagagggcccattagttgcagattacgatgtatccagttaggtgcacctgccttcgagaagtgtaaaaataagtatttacatagaaagaaagactgaatggatgcacggtgaatgcatgaatgattgaacgacagaaaagatttgcattgaccgatgaggagggcattgtagacagggatgagggtcattgatcctgggtgcagatctccaaaagaatgacagaaagaaagagggagtggtggaaagaaacaataggatgggaaaaaatgaaaatagaaaaaaggaagtgaaagagataataaataattagatcaaataagttgatgaaaggggactggtttagcacaagccatccacattaattcaaacctgtggctctgaagtttgttttttaaatgaccacaagtgtaagactgaatgaaagaataaatgcgtgcattccataggatgcaagaaaaggagtgaggaatgggaaaattggaagaacgagagagggagagatgtaagaaaagaaaggaaaagtgaagtaggcatatgaaagaaaaggcacttcttggacaagcactgaaatataatgagacagttttacccattaaatataataaacagtaaacgttgaggttcatcaataaaagcacagatacctgaatagaggagtgacctgaatagaattcgttcagccgaacgaatgagaatggatgattttcactatcctgtgcactcaaggcccaaaagagaaagcaagagaggagagaatatggaaacgtatgacaggatgtatataagcaatacaaacatattgaatgaataaataaagacataaatatgtgggagagtggaccacgcaaggacaaaaagaggagagaaggcagcaagaattatgactaattcaaaactgggttcctgagatagttaaataaatcctgcaccaaatccccagggggagaaattaacaaacaaaagacagccccacacggaccagtgtgcagaaggctccaggaaccgcagattatggttaatccaattctgtgcacctgaggtccataaataaaagaataagtattgaaatgaaagaatgacagaaagaatgaatggacacatgaacgactgaattagaaatggaaatgcctggcacagccaggaaggagctgcccatgggattgtcattcatctcactctgggcacctgaggtccataagcgtgaaaagaggcaggaagagaagtgtcagggagtcaaagatagagctaaggaaaggcaaaaatgaaactaaatgaaagcgaaagggaaaataaagaaaaaccaataaaaaagagaacgaatacgtgggtgtatctgtaagagtaggatctgttaggattagtcataagactgtcagtaatcctgaagatggatgagataatccaggcccaggttcccagggggagggaaaatggagaaaatataaaaagatgtgaaaaaggaaaaaggaaaggtaataaacaaacaaccaaagtgataaatggatagttaagggaggttgtctgaacagggattataattagtttacatacatactccttaaacagataaatacattacacctttcaaagaataaatgaaaaatagagagacatacctggctccaaaacaaggctgtatcttctgccactgtaataaaatagatgcaattgaggttcataaataaaagaataaatacttaaacgtgaaaggtgactaaatgcggggaatgcataagggggtatcctctagagg

SEQ ID NO: 736356 - DNA, 9659 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagcccatcacctggatgcctacgtgggaagggacctcgaatgtgggaccccagcccctctccagctcgaaatcggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaacccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaaggccagcgaggccgggagcaggtggccttcatctgcaactgtgtctctctcagcctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaaaaaaaaaaaaaaaaaaaaaaaaaaaaaaaaaaaaaaaaaaaaaaaaaaaaaaaaaaaaaaaaaaaaaaaaacaaaaaaaaatataacataaaagaaaaaaaaataataaacaaccaaaaatctaaaataaaaccgtggccctttttttaaaaaccatgctaaagggaaaacccttgccgtgccccaatttaaccgtttgggagaaatccccttttcgcggggggttattttcaaagggcccctcgcaaacccttgtcaaacagtccaaaccctgatggcaaaggcaattttacgctttattttttgtaaaatcccttaaattttggccaaaaacctgttttttacccaataggccaaatgcctaaatccctttaaattaaagaaattccccgaataggttggacttctccacatttgaaccaaagtcccttttaaaaaagggcttcaactgcaagggggctcgttttagggctgtgcgcctttggaaccatccccttataaatattgaggtcaggggcacaggattatattgcaccctgggacctcctttttctcct

SEQ ID NO: 736357 - DNA, 8133 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagcccatcacctggatgcctacgtgggaagggacctcgaatgtgggaccccagcccctctccagctcgaaatcggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagaaaaaaaaaaaacacccaacaaaaacaaacaaatccacaacaaaaacacg

SEQ ID NO: 736358 - DNA, 8184 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagcccatcacctggatgcctacgtgggaagggacctgggtgggggagggggggggggtgttcattcttaaattcctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaaaaaaaaaaaaaaaaaaaaaaaaaaaaaaaaaaaaaaaaaaaaaaaaaaaaaaaaaaaaaaaaaaaaaaaaacaaaaaaaaatataacataaaagaaaaaaaaataataaacaaccaaaaatctaaaataaaaccgtggccctttttttaaaaaccatgctaaagggaaaacccttgccgtgccccaatttaaccgtttgggagaaatccccttttcgcggggggttattttcaaagggcccctcgcaaacccttgtcaaacagtccaaaccctgatggcaaaggcaattttacgctttattttttgtaaaatcccttaaattttggccaaaaacctgttttttacccaataggccaaatgcctaaatccctttaaattaaagaaattccccgaataggttggacttctccacatttgaaccaaagtcccttttaaaaaagggcttcaactgcaagggggctcgttttagggctgtgcgcctttggaaccatccccttataaatattgaggtcaggggcacaggattatattgcaccctgggacctcctttttctcct

SEQ ID NO: 736359 - DNA, 7346 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggggtcctaagcctttgggtcccacagagcacgacttcgctccgtgaacagcaccaacccaagtctgttccatgtctccacacctgccccttccgctccataggcagctggtgggtgagtggagtcaggagagaa

SEQ ID NO: 736360 - DNA, 8015 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaaaaaaaaaaaaaaaaaaaaaaaaaaaaaaaaaaaaaaaaaaaaaaaaaaaaaaaaaaaaaaaaaaaaaaaaacaaaaaaaaatataacataaaagaaaaaaaaataataaacaaccaaaaatctaaaataaaaccgtggccctttttttaaaaaccatgctaaagggaaaacccttgccgtgccccaatttaaccgtttgggagaaatccccttttcgcggggggttattttcaaagggcccctcgcaaacccttgtcaaacagtccaaaccctgatggcaaaggcaattttacgctttattttttgtaaaatcccttaaattttggccaaaaacctgttttttacccaataggccaaatgcctaaatccctttaaattaaagaaattccccgaataggttggacttctccacatttgaaccaaagtcccttttaaaaaagggcttcaactgcaagggggctcgttttagggctgtgcgcctttggaaccatccccttataaatattgaggtcaggggcacaggattatattgcaccctgggacctcctttttctcct

SEQ ID NO: 736361 - DNA, 8148 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttccggaagcccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaaaaaaaaaaaaaaaaaaaaaaaaaaaaaaaaaaaaaaaaaaaaaaaaaaaaaaaaaaaaaaaaaaaaaaaaacaaaaaaaaatataacataaaagaaaaaaaaataataaacaaccaaaaatctaaaataaaaccgtggccctttttttaaaaaccatgctaaagggaaaacccttgccgtgccccaatttaaccgtttgggagaaatccccttttcgcggggggttattttcaaagggcccctcgcaaacccttgtcaaacagtccaaaccctgatggcaaaggcaattttacgctttattttttgtaaaatcccttaaattttggccaaaaacctgttttttacccaataggccaaatgcctaaatccctttaaattaaagaaattccccgaataggttggacttctccacatttgaaccaaagtcccttttaaaaaagggcttcaactgcaagggggctcgttttagggctgtgcgcctttggaaccatccccttataaatattgaggtcaggggcacaggattatattgcaccctgggacctcctttttctcct

SEQ ID NO: 736362 - DNA, 7887 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctggacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaaaaaaaaaaaaaaaaaaaaaaaaaaaaaaaaaaaaaaaaaaaaaaaaaaaaaaaaaaaaaaaaaaaaaaaaacaaaaaaaaatataacataaaagaaaaaaaaataataaacaaccaaaaatctaaaataaaaccgtggccctttttttaaaaaccatgctaaagggaaaacccttgccgtgccccaatttaaccgtttgggagaaatccccttttcgcggggggttattttcaaagggcccctcgcaaacccttgtcaaacagtccaaaccctgatggcaaaggcaattttacgctttattttttgtaaaatcccttaaattttggccaaaaacctgttttttacccaataggccaaatgcctaaatccctttaaattaaagaaattccccgaataggttggacttctccacatttgaaccaaagtcccttttaaaaaagggcttcaactgcaagggggctcgttttagggctgtgcgcctttggaaccatccccttataaatattgaggtcaggggcacaggattatattgcaccctgggacctcctttttctcct

SEQ ID NO: 736363 - DNA, 8308 bp, Homo sapiens
gattcgtttacccaagagggaacagttttgagaccccccggattcactgcggagtggccgcagaggccggggtcggcctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagcccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctgggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagatgaggtgaactggccaccgccgggccggggcgatgtggcttcttaagccacacttctaattttggtgatggagccgacatttctttggctcctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctgtagtcaccccactccaccgaaaagtaaactgcaggtgaggccgtgcccgagtctttcttcggtgtgtttggcttttccggggcgcttgccttgccatgattctaactctctgcccttccccaaggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagcccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaaaaaaaaaaaaaaaaaaaaaaaaaaaaaaaaaaaaaaaaaaaaaaaaaaaaaaaaaaaaaaaaaaaaaaaaacaaaaaaaaatataacataaaagaaaaaaaaataataaacaaccaaaaatctaaaataaaaccgtggccctttttttaaaaaccatgctaaagggaaaacccttgccgtgccccaatttaaccgtttgggagaaatccccttttcgcggggggttattttcaaagggcccctcgcaaacccttgtcaaacagtccaaaccctgatggcaaaggcaattttacgctttattttttgtaaaatcccttaaattttggccaaaaacctgttttttacccaataggccaaatgcctaaatccctttaaattaaagaaattccccgaataggttggacttctccacatttgaaccaaagtcccttttaaaaaagggcttcaactgcaagggggctcgttttagggctgtgcgcctttggaaccatccccttataaatattgaggtcaggggcacaggattatattgcaccctgggacctcctttttctcct

SEQ ID NO: 736364 - DNA, 2037 bp, Homo sapiens; identical to SEQ ID NO: 4922

SEQ ID NO: 736365 - DNA, 2425 bp, Homo sapiens
  misc_feature (1)..(1): n is a, c, g, or t
  misc_feature (849)..(849): n is a, c, g, or t
ngggtgcgagctggagactccgcgggagcgcggccgggaggcttcgccccggagctggcccgacgcctcccgagctggcagggctctcggcggaggtcggagcgtgggcttcctcctcccgccagggaaaacagagaggatgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaaggcctcagggaaactcatgatgtcttttgtgctctctgctgatctcacgccttagtgtggaccaatgccatgaaactgtcagaaaaatcagtggccgaggggattcctggggcagttccccctgcggagatttatgtggaggnggacttggcccagcaggacaagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccagtggaaagtactagagaaacctcgtcccaccaggcctcatgtgatcctctaccagaagctggagcagccaccttggggatcagcagacaccagcagcaggccaaaggatagtggagtggagggacaagaaggcctgggtgagccttctctgagaatcactgagctctgaaccatgaatgaactgcctacctctgtacttcctgttgtataggacaaagaaatccctatctatttaaaccactgtagtcaggtctatgtatttgtgctgtggaacaaaccacccaaactgagtgacttaaaatgacaaatatttatt

SEQ ID NO: 736366 - DNA, 3105 bp, Homo sapiens
ggactgacagcctcaatatttatttcacagtctggtgccaacttagcaattacggaagagcgctcccggccccagacttcccattggataattggcagcaagaggctcttctgagggtttgagacatgtgtgtgcactgaccacaggcatcgttcgggttaggcaggcgtgcctaaaaagtaattaaagcctgctgttctcttttcttctgtgggtcccgccactccccgtgagcggtgaagattctgataacgcggaatggtcattcaggcgtgcaaaccctgctaagtggtgtttcccgcaccctgccatggaaacgctgcccccacttgccggcccctgctgaccccctgacactgttgccccctctctgctgcagctggagcacttcagaagtcaagtcatcaaggccacctatggacgggcgaagccgttccgggacaagcccgtcaccgaccaacaggttagtctgccgtccctgccacgtggctccttcactttcctcttcttcttcttcgtggatctggattccagaccctgggagcatatgtttctgtttttgttggtggcatatttttcacactgttgctacaccataaagatttgttttgattttatgggatttcctggcttttaaagtaaaagccagttaaaactcccttgaaatgtgtctgtgaaaatcaaattaaaccattcgggcttacttctggtctccagacatgcatgtttcgcctccattagcactgggagaaagggagccgcctccccacagccagtgcgttctggcgcgttccttcagaggagaaaagttgacagtggcagtgagggtggatgtctggctgtaatgattgccttgctgttcttccactacactttctagccccctgtgtcaaagcacagatgggaaaatgtgccgtgggctgctctcagtgggtgtgggagaacctgacctgctgcttatgagcccataatatcaggctcagtgttctgaatccctatacaacacagaagaatctggaacaaactcagggccacaagacaggcctttggatcataaaaataatctctgatcggcaaggagtggtggctcatgcctgtaatgccagcactttgagaggccgaggcgggtggatcacctcaggtcgggagttcgaaaccagcctgaccaacatggtaaaaccccatctctattaaaaatacaaaattagccgggcatggtggcgcgtgcctgtaatctcagctacttcagaggctgaggcaggagaatcgcttgaacccaggaggcggaggttgcggtgagccgagatcaaaccattgcactccagcctgggcaacaagagtgaaactccgtcgcaaaaaaaaaaaaaagaaaagaaaaaagaaaagagaatctctgattctgggactcattccctggtgacaggaccaacgtcccccttgacagccatcaccaagacatatcaggacctctgtcctcccgtgcttagacagggacttaagttgcatctctcccctctcccattccccttccctcagggccccccacccctgtatgttacatctttttttttttttcctttttctttttctcaccagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggtggcccctccttacgctttccacaaatggtctctttgtctaatttttgtgcggcttatttgggaaattgcccagcttttttggagcaagttgggcagaaatgcttggcttttctatccactttttcctcttgttggagaaacttgttggagaagaaaaaacaaagggcctaaaaaaatgcctcccgggagaacttggcgtgtccaaaaaagatgcctgagcatcttcaattactgactttgagcggcccgcatccccagccaaaaagaaattgttttcatagcccctatgttatttccagagaaaccaaagaaacattcctgctttttatttgcattttcttgttttggcccagccacaaaaggcggtttccacaccgttgcttttgactctggaggagcagggacgggaggacttggccacagccctgcggcccccaccctgggacatggcttatcagagcaggcggtggcttctgctttctctggaaatcagcagctcctgtttggggagtttgtgcaaatgctggcttgtcagcactctttcaaatcaggaaaccacgctttccgaccagcttgtgtgttgatcttggcaggaattctgacgaatggaaaaaagaagtagccacatttgcttctcattgcagccaaactgttgatggtactttggctctggggtttcatagacctaaaagggggttcgctttgaccatcaaaagtccaaattagagtattaaaaaaaaacctgtcaaaacataaaaattttaaaaaagaaaaaaactgagtcctcccaaggcggccaatacgtggcgctgcctgcttcgtggcagagtcaagaacgctgttcctcgaaggtcacgtcaggggctatttctggccacagggcctgggctcctcatgatctcacctctttgcaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaaggttactgggactttttttctcacatggttgcatgactctaaaatgtcgcgttgaatctcagcatgatgggacatctgttgaggaagtcttcctgggtatctggccaagtctattcccttctccagaaccccctgcttctctgctagaaatcttcaaaatcttcgcagaactctccaccgacttccttttttcttctctgattaccttctccttttaacatcggcatcccaaatgccttattttt

SEQ ID NO: 736367 - DNA, 3515 bp, Homo sapiens
  misc_feature (746)..(746): n is a, c, g, or t
gttctcggtggtctcctcctgcttggagttgctcagctgggtctctttctggaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgnagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagtagatgggagcttccagcccctgcctcgcagacagatggtgaggatgaaagaatgcaggcatccctcgctatctgctgtccactctcgctgtcgtcatacctcaggagccaagtgcttttggatggtgagggtgcttgtcccgtctctgaagcacctgcccagggcctggcaccagccggcggacactgccttccccatgctgcccatgacccatgctgcccgtgacccatgcaggtggtctcctgggtgagtcctgcctcagacccggtagggtctacacactggaaagtttccccaaagcaagtcacacatgagcagcacccgggcggcttccaaagctccctgaaagctggcagaggggctttcctgtctgctttgcagttgacatattcatcatccactcctgcagtccacaaggcactggaacagtgacctctaaatagagccagactctccctttccttcactcttgcctaaggtggagcagatcccaaggctggggttaggcaagtcagggaaagaaccacagtcactgtttcttcatgaccgtctccaggccagggactgggctcacctgagctttgcagccgtgatagggcttattaatgcctctaatagccctgcctggtacgatgatccctattttacagatgaggaaactgcgcctcagagagttaagaggcgcccaagtgcacacagcggctggtaaggacagctgggacctgaccccagatccctctgaccctggttctcctgctgtctgcagggttggccgtgagtcccctccttgtaactgtcagcttttatgtgtgtgtgcattctcgtgtgtgtgtacattctcatgtgtgtgtgtgtgtgcacatgtgtaccatgtgcatgagggtttggctgtgtgtgacactatgtgtgtgtgtttgtgtgtgttgcctgcctgagctcagagagagccaaacccccagagaagggtgccccctccaccaaccaggtgagctccttgcagaggcctggccttcatcccacaaaccttgcagaccacaggctccctggcttgcagcccccaaaaatgaaggcagcgctctgctctggacgtggcctttccagcactcaccactctgaattaaacatcacaggcccccatctgcacatgtcgtggggctgcctcgggcagaggaccgtttccttttacgctgtgccatgccagggagatctgggcagcagcagagtcctgagatgtcctttgatgtacccacaggagagttcgctccttcccgaggcagtgtcccccagggcttggcaggccaggcccacagcagagacaccaaaccacagaatgggacggcagagggccctaaaaagcccattgtcatgcactggctgaaaatgaaagaaaacctgcagattt

SEQ ID NO: 736368 - DNA, 424 bp, Homo sapiens; identical to SEQ ID NO: 302862

SEQ ID NO: 736369 - DNA, 964 bp, Homo sapiens
cagcccgctacgcagtacgtttaccacggtgagactgggacaggcccctaaagggagttcaaccatcatgggccccaccatccctgagccattgggataccgaggtgtgaaccaccgggcatctgcagccccttccacttgctctgggaggcgctgcctcgagctaaaacagacgtgtcctccgagaagagcattgttcctcacaggccctgggttgagcagcctccacctctgctggaatctagaacagagacccccaagagactcagcaagatggggcactgtggctcccaaaagctgtgcccccttctcgttgagaaaatggatttttctcaattttcagatgctacctgtttggaatgctgtccctgggaaggcccagcgttccaaatggttagcatctaaaagtggagaaaaatccatttttctttgatgcaaaaggcaaagaggaatctaagctagattttgttcttattctttctgtattgaagagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctaccagaagctggagcagccaccttggggatcagcagacaccagcagcaggccaaaggatagtggagtggagggacaagaaggcctgggtgagccttctctgagaatcactgagctctgaaccatgaatgaactgcctacctctgtacttcctgttgtataggacaaagaaatccctatctatttaaaccactgtagtcaggtctatgtatttgtgctgtggaacaaaccacccaaactgagtgacttaaaatgacaaatatttatt

SEQ ID NO: 736370 - DNA, 6470 bp, Homo sapiens
  misc_feature (917)..(917): n is a, c, g, or t
  misc_feature (4266)..(4266): n is a, c, g, or t
aaaattctctctcatccccttgggattcaaagctgagaagatgtaaggactggagctgcagcagtctttctgggaccattatacagagattctgtctgaggttggatccacgtggtcaaaagtattgctgaggagccagagagagactgaggtctgatgacatcacttgagccctgcagacttttcatttacgggaaaacagagaggatgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaaggcctcagggaaactcatgatgtcttttgtgctctctgctgatctcacgccttagtgtggaccaatgccatgaaactgtcagaaaaatcagtggccgaggggattcctggggcagttccccctgcggagatttatgtggaggnggacttggcccagcaggacaagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagactggagcacttcagaagtcaagtcatcaaggccacctatggacgggcgaagccgttccgggacaagcccgtcaccgaccaacaggttagtctgccgtccctgccacgtggctccttcactttcctcttcttcttcttcgtggatctggattccagaccctgggagcatatgtttctgtttttgttggtggcatatttttcacactgttgctacaccataaagatttgttttgattttatgggatttcctggcttttaaagtaaaagccagttaaaactcccttgaaatgtgtctgtgaaaatcaaattaaaccattcgggcttacttctggtctccagacatgcatgtttcgcctccattagcactgggagaaagggagccgcctccccacagccagtgcgttctggcgcgttccttcagaggagaaaagttgacagtggcagtgagggtggatgtctggctgtaatgattgccttgctgttcttccactacactttctagccccctgtgtcaaagcacagatgggaaaatgtgccgtgggctgctctcagtgggtgtgggagaacctgacctgctgcttatgagcccataatatcaggctcagtgttctgaatccctatacaacacagaagaatctggaacaaactcagggccacaagacaggcctttggatcataaaaataatctctgatcggcaaggagtggtggctcatgcctgtaatgccagcactttgagaggccgaggcgggtggatcacctcaggtcgggagttcgaaaccagcctgaccaacatggtaaaaccccatctctattaaaaatacaaaattagccgggcatggtggcgcgtgcctgtaatctcagctacttcagaggctgaggcaggagaatcgcttgaacccaggaggcggaggttgcggtgagccgagatcaaaccattgcactccagcctgggcaacaagagtgaaactccgtcgcaaaaaaaaaaaaaagaaaagaaaaaagaaaagagaatctctgattctgggactcattccctggtgacaggaccaacgtcccccttgacagccatcaccaagacatatcaggacctctgtcctcccgtgcttagacagggacttaagttgcatctctcccctctcccattccccttccctcagggccccccacccctgtatgttacatctttttttttttttcctttttctttttctcaccagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggtggcccctccttacgctttccacaaatggtctctttgtctaatttttgtgcggcttatttgggaaattgcccagcttttttggagcaagttgggcagaaatgcttggcttttctatccactttttcctcttgttggagaaacttgttggagaagaaaaaacaaagggcctaaaaaaatgcctcccgggagaacttggcgtgtccaaaaaagatgcctgagcatcttcaattactgactttgagcggcccgcatccccagccaaaaagaaattgttttcatagcccctatgttatttccagagaaaccaaagaaacattcctgctttttatttgcattttcttgttttggcccagccacaaaaggcggtttccacaccgttgcttttgactctggaggagcagggacgggaggacttggccacagccctgcggcccccaccctgggacatggcttatcagagcaggcggtggcttctgctttctctggaaatcagcagctcctgtttggggagtttgtgcaaatgctggcttgtcagcactctttcaaatcaggaaaccacgctttccgaccagcttgtgtgttgatcttggcaggaattctgacgaatggaaaaaagaaggctgttcctcgaaggtcacgtcaggggctatttctggccacagggcctgggctcctcatgatctcacctctttgcaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgnagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaaggaaagtgtagaggagcacgaactgagaaacgcaaaagaatcgacaccttgcaactgtgccttcaaagagaaagacaggcaggccctgccccacctgcctgcagtttgaacggatgacctaagagacaagcacgcgtccagccccgtctgtccattaagagtcttgctctattgcccaggctagagtgcagtggtgcaatttcggctcactgcaacctccacctcccaggttcaagcgattctcctgcctcagcctcccgagtagctgggactacaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctctaggacgggccatgttggaccaatctggctaatgacatataaggaaaagctcctgtggagggcttcccttccagcttctctaggtgaaagcattcacccttggtacctttgtcttgtctcctttctcactcctggagctcagaccagaagctggagcagccaccttggggatcagcagacaccagcagcaggccaaaggatagtggagtggagggacaagaaggcctgggtgagccttctctgagaatcactgagctctgaaccatgaatgaactgcctacctctgtacttcctgttgtataggacaaagaaatccctatctatttaaaccactgtagtcaggtctatgtatttgtgctgtggaacaaaccacccaaactgagtgacttaaaatgacaaatatttatt

SEQ ID NO: 736371 - DNA, 3713 bp, Homo sapiens
  misc_feature (917)..(917): n is a, c, g, or t
aaaattctctctcatccccttgggattcaaagctgagaagatgtaaggactggagctgcagcagtctttctgggaccattatacagagattctgtctgaggttggatccacgtggtcaaaagtattgctgaggagccagagagagactgaggtctgatgacatcacttgagccctgcagacttttcatttacgggaaaacagagaggatgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaaggcctcagggaaactcatgatgtcttttgtgctctctgctgatctcacgccttagtgtggaccaatgccatgaaactgtcagaaaaatcagtggccgaggggattcctggggcagttccccctgcggagatttatgtggaggnggacttggcccagcaggacaagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagactggagcacttcagaagtcaagtcatcaaggccacctatggacgggcgaagccgttccgggacaagcccgtcaccgaccaacaggttagtctgccgtccctgccacgtggctccttcactttcctcttcttcttcttcgtggatctggattccagaccctgggagcatatgtttctgtttttgttggtggcatatttttcacactgttgctacaccataaagatttgttttgattttatgggatttcctggcttttaaagtaaaagccagttaaaactcccttgaaatgtgtctgtgaaaatcaaattaaaccattcgggcttacttctggtctccagacatgcatgtttcgcctccattagcactgggagaaagggagccgcctccccacagccagtgcgttctggcgcgttccttcagaggagaaaagttgacagtggcagtgagggtggatgtctggctgtaatgattgccttgctgttcttccactacactttctagccccctgtgtcaaagcacagatgggaaaatgtgccgtgggctgctctcagtgggtgtgggagaacctgacctgctgcttatgagcccataatatcaggctcagtgttctgaatccctatacaacacagaagaatctggaacaaactcagggccacaagacaggcctttggatcataaaaataatctctgatcggcaaggagtggtggctcatgcctgtaatgccagcactttgagaggccgaggcgggtggatcacctcaggtcgggagttcgaaaccagcctgaccaacatggtaaaaccccatctctattaaaaatacaaaattagccgggcatggtggcgcgtgcctgtaatctcagctacttcagaggctgaggcaggagaatcgcttgaacccaggaggcggaggttgcggtgagccgagatcaaaccattgcactccagcctgggcaacaagagtgaaactccgtcgcaaaaaaaaaaaaaagaaaagaaaaaagaaaagagaatctctgattctgggactcattccctggtgacaggaccaacgtcccccttgacagccatcaccaagacatatcaggacctctgtcctcccgtgcttagacagggacttaagttgcatctctcccctctcccattccccttccctcagggccccccacccctgtatgttacatctttttttttttttcctttttctttttctcaccagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaaggttactgggactttttttctcacatggttgcatgactctaaaatgtcgcgttgaatctcagcatgatgggacatctgttgaggaagtcttcctgggtatctggccaagtctattcccttctccagaaccccctgcttctctgcttgaggcgtaattttccattaaaaaaaaaaacacacacatacaagtgagacacgataactgaagaaaaatgaaacaaaacagaggcaaaaggaaaattaaatcgaaattatgcaaagtctaattacgctgtttaacctccaaggcattttcccatggaaataaccgcgtgattccaggcaagtgacttaccctgtctatgcctcagtttccctatctgtaaaatgaggctaatagggagtacccaccctttagggctgttgtgatcattaaaatgcatgaatatatggaaagtacttggaatagtacctggcacacaataggcattactgaatgtttattgacttttaatttgacaaaaaaatagtgtcacgttaccctcgattttctttggtttattcctaatggtacgtcatccatgtcagtagacacagacctacatcatcgctgttaccgacggcagttactgattccattgtgtaggatgtgccattgttttagacaatcccctatcatgggcacttaggtgatttccagtttttcacactcataaatcatgctgggatgaacattgttgcacacatacctgctcatattatctttattctcctagaggtggagaggtatgaatcactttctttcaacaaatagtgattgcatgcatgcttaccagaggccacatgttgtgcagggcagagacgtaacggggtcaggaacaggtagaatcaggtcatgggtatatggttcactgtaaaattcttccaatatgtccatacatttgaaattttttataataaaatactggggaaaaa

SEQ ID NO: 736372 - DNA, 5524 bp, Homo sapiens
  misc_feature (917)..(917): n is a, c, g, or t
  misc_feature (3568)..(3568): n is a, c, g, or t
aaaattctctctcatccccttgggattcaaagctgagaagatgtaaggactggagctgcagcagtctttctgggaccattatacagagattctgtctgaggttggatccacgtggtcaaaagtattgctgaggagccagagagagactgaggtctgatgacatcacttgagccctgcagacttttcatttacgggaaaacagagaggatgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaaggcctcagggaaactcatgatgtcttttgtgctctctgctgatctcacgccttagtgtggaccaatgccatgaaactgtcagaaaaatcagtggccgaggggattcctggggcagttccccctgcggagatttatgtggaggnggacttggcccagcaggacaagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagactggagcacttcagaagtcaagtcatcaaggccacctatggacgggcgaagccgttccgggacaagcccgtcaccgaccaacaggttagtctgccgtccctgccacgtggctccttcactttcctcttcttcttcttcgtggatctggattccagaccctgggagcatatgtttctgtttttgttggtggcatatttttcacactgttgctacaccataaagatttgttttgattttatgggatttcctggcttttaaagtaaaagccagttaaaactcccttgaaatgtgtctgtgaaaatcaaattaaaccattcgggcttacttctggtctccagacatgcatgtttcgcctccattagcactgggagaaagggagccgcctccccacagccagtgcgttctggcgcgttccttcagaggagaaaagttgacagtggcagtgagggtggatgtctggctgtaatgattgccttgctgttcttccactacactttctagccccctgtgtcaaagcacagatgggaaaatgtgccgtgggctgctctcagtgggtgtgggagaacctgacctgctgcttatgagcccataatatcaggctcagtgttctgaatccctatacaacacagaagaatctggaacaaactcagggccacaagacaggcctttggatcataaaaataatctctgatcggcaaggagtggtggctcatgcctgtaatgccagcactttgagaggccgaggcgggtggatcacctcaggtcgggagttcgaaaccagcctgaccaacatggtaaaaccccatctctattaaaaatacaaaattagccgggcatggtggcgcgtgcctgtaatctcagctacttcagaggctgaggcaggagaatcgcttgaacccaggaggcggaggttgcggtgagccgagatcaaaccattgcactccagcctgggcaacaagagtgaaactccgtcgcaaaaaaaaaaaaaagaaaagaaaaaagaaaagagaatctctgattctgggactcattccctggtgacaggaccaacgtcccccttgacagccatcaccaagacatatcaggacctctgtcctcccgtgcttagacagggacttaagttgcatctctcccctctcccattccccttccctcagggccccccacccctgtatgttacatctttttttttttttcctttttctttttctcaccagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgnagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagtagatgggagcttccagcccctgcctcgcagacagatggtgaggatgaaagaatgcaggcatccctcgctatctgctgtccactctcgctgtcgtcatacctcaggagccaagtgcttttggatggtgagggtgcttgtcccgtctctgaagcacctgcccagggcctggcaccagccggcggacactgccttccccatgctgcccatgacccatgctgcccgtgacccatgcaggtggtctcctggatgaggaaactgcgcctcagagagttaagaggcgcccaagtgcacacagcggctgagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttaccctag

SEQ ID NO: 736373 - DNA, 5772 bp, Homo sapiens
  misc_feature (917)..(917): n is a, c, g, or t
  misc_feature (3568)..(3568): n is a, c, g, or t
aaaattctctctcatccccttgggattcaaagctgagaagatgtaaggactggagctgcagcagtctttctgggaccattatacagagattctgtctgaggttggatccacgtggtcaaaagtattgctgaggagccagagagagactgaggtctgatgacatcacttgagccctgcagacttttcatttacgggaaaacagagaggatgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaaggcctcagggaaactcatgatgtcttttgtgctctctgctgatctcacgccttagtgtggaccaatgccatgaaactgtcagaaaaatcagtggccgaggggattcctggggcagttccccctgcggagatttatgtggaggnggacttggcccagcaggacaagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagactggagcacttcagaagtcaagtcatcaaggccacctatggacgggcgaagccgttccgggacaagcccgtcaccgaccaacaggttagtctgccgtccctgccacgtggctccttcactttcctcttcttcttcttcgtggatctggattccagaccctgggagcatatgtttctgtttttgttggtggcatatttttcacactgttgctacaccataaagatttgttttgattttatgggatttcctggcttttaaagtaaaagccagttaaaactcccttgaaatgtgtctgtgaaaatcaaattaaaccattcgggcttacttctggtctccagacatgcatgtttcgcctccattagcactgggagaaagggagccgcctccccacagccagtgcgttctggcgcgttccttcagaggagaaaagttgacagtggcagtgagggtggatgtctggctgtaatgattgccttgctgttcttccactacactttctagccccctgtgtcaaagcacagatgggaaaatgtgccgtgggctgctctcagtgggtgtgggagaacctgacctgctgcttatgagcccataatatcaggctcagtgttctgaatccctatacaacacagaagaatctggaacaaactcagggccacaagacaggcctttggatcataaaaataatctctgatcggcaaggagtggtggctcatgcctgtaatgccagcactttgagaggccgaggcgggtggatcacctcaggtcgggagttcgaaaccagcctgaccaacatggtaaaaccccatctctattaaaaatacaaaattagccgggcatggtggcgcgtgcctgtaatctcagctacttcagaggctgaggcaggagaatcgcttgaacccaggaggcggaggttgcggtgagccgagatcaaaccattgcactccagcctgggcaacaagagtgaaactccgtcgcaaaaaaaaaaaaaagaaaagaaaaaagaaaagagaatctctgattctgggactcattccctggtgacaggaccaacgtcccccttgacagccatcaccaagacatatcaggacctctgtcctcccgtgcttagacagggacttaagttgcatctctcccctctcccattccccttccctcagggccccccacccctgtatgttacatctttttttttttttcctttttctttttctcaccagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgnagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaaggaaagtgtagaggagcacgaactgagaaacgcaaaagaatcgacaccttgcaactgtgccttcaaagagaaagacaggcaggccctgccccacctgcctgcagtttgaacggatgacctaagagacaagcacgcgtccagccccgtctgtccattaagagtcttgctctattgcccaggctagagtgcagtggtgcaatttcggctcactgcaacctccacctcccaggttcaagcgattctcctgcctcagcctcccgagtagctgggactacaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctctaggacgggccatgttggaccaatctggctaatgacatataaggaaaagctcctgtggagggcttcccttccagcttctctaggtgaaagcattcacccttggtacctttgtcttgtctcctttctcactcctggagctcagaccagaagctggagcagccaccttggggatcagcagacaccagcagcaggccaaaggatagtggagtggagggacaagaaggcctgggtgagccttctctgagaatcactgagctctgaaccatgaatgaactgcctacctctgtacttcctgttgtataggacaaagaaatccctatctatttaaaccactgtagtcaggtctatgtatttgtgctgtggaacaaaccacccaaactgagtgacttaaaatgacaaatatttatt

SEQ ID NO: 736374 - DNA, 3240 bp, Homo sapiens
  misc_feature (917)..(917): n is a, c, g, or t
aaaattctctctcatccccttgggattcaaagctgagaagatgtaaggactggagctgcagcagtctttctgggaccattatacagagattctgtctgaggttggatccacgtggtcaaaagtattgctgaggagccagagagagactgaggtctgatgacatcacttgagccctgcagacttttcatttacgggaaaacagagaggatgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaaggcctcagggaaactcatgatgtcttttgtgctctctgctgatctcacgccttagtgtggaccaatgccatgaaactgtcagaaaaatcagtggccgaggggattcctggggcagttccccctgcggagatttatgtggaggnggacttggcccagcaggacaagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagactggagcacttcagaagtcaagtcatcaaggccacctatggacgggcgaagccgttccgggacaagcccgtcaccgaccaacaggttagtctgccgtccctgccacgtggctccttcactttcctcttcttcttcttcgtggatctggattccagaccctgggagcatatgtttctgtttttgttggtggcatatttttcacactgttgctacaccataaagatttgttttgattttatgggatttcctggcttttaaagtaaaagccagttaaaactcccttgaaatgtgtctgtgaaaatcaaattaaaccattcgggcttacttctggtctccagacatgcatgtttcgcctccattagcactgggagaaagggagccgcctccccacagccagtgcgttctggcgcgttccttcagaggagaaaagttgacagtggcagtgagggtggatgtctggctgtaatgattgccttgctgttcttccactacactttctagccccctgtgtcaaagcacagatgggaaaatgtgccgtgggctgctctcagtgggtgtgggagaacctgacctgctgcttatgagcccataatatcaggctcagtgttctgaatccctatacaacacagaagaatctggaacaaactcagggccacaagacaggcctttggatcataaaaataatctctgatcggcaaggagtggtggctcatgcctgtaatgccagcactttgagaggccgaggcgggtggatcacctcaggtcgggagttcgaaaccagcctgaccaacatggtaaaaccccatctctattaaaaatacaaaattagccgggcatggtggcgcgtgcctgtaatctcagctacttcagaggctgaggcaggagaatcgcttgaacccaggaggcggaggttgcggtgagccgagatcaaaccattgcactccagcctgggcaacaagagtgaaactccgtcgcaaaaaaaaaaaaaagaaaagaaaaaagaaaagagaatctctgattctgggactcattccctggtgacaggaccaacgtcccccttgacagccatcaccaagacatatcaggacctctgtcctcccgtgcttagacagggacttaagttgcatctctcccctctcccattccccttccctcagggccccccacccctgtatgttacatctttttttttttttcctttttctttttctcaccagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggaggttttggagagcagcatagcccatgaaaaaagaaaagcaa

SEQ ID NO: 736375 - DNA, 853 bp, Homo sapiens; identical to SEQ ID NO: 426682

SEQ ID NO: 736376 - DNA, 3239 bp, Homo sapiens
ggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactggtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgaaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagctgtggatttctatcaacagaggccaactgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaattttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgtccatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttacagccaagttttcaccaaatcacaactatcatcaccaccaaaattttaaaaaacagtagttgactactaaaaagtaatcagtggacaggtcatttatgggatcagtaagcacagtagtgtgattatatctgggaaaacatctacagttgtacagctgtatcctcctcaaaatccggtgaagaatgctatttttctaggctgagcttttgttataaacttaatattcagaaggcaagggttatgatcctgatgtgtcctttttttttgcatttgttaattctgaatgtatttttaacagaatgatttttttgacttactagtgtaatttgcattttaaaaataaatggaaaaatactt

SEQ ID NO: 736377 - DNA, 1249 bp, Homo sapiens
  misc_feature (834)..(834): n is a, c, g, or t
ggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactggtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcagtaagtgttggcagccaaccgctccttctagtgcctctggggttgttttatttctgtgcgaactcagtgcacacaaatggaatctgtgggtaaagtgtggcctttttgctttttcctcattaatgcgacttttaacaggaaatcctcaggttaaacnaaaccatcctctggacttagtgtgctgattttcttcgacaattagtaaataccctttgttatcatcagcattttacataggaaatccaatcagtcaagatgtgattacgtgacttttggtagacttttccaaggattctgaagggatgatcagagatttttttcataacgttctacagtactcaaaattataagatttccataagtgttttctcttttagtgcttcttttggctgtgctgctagccctgggatttctctttttcatttgccctatctccttcttccttcctagatttctcccaggcaccatccatcacctttaatctcccactttttttccagaaaaaatcacattttctatagattctaattctaagacattcatgcccccatttttcatagtactgtaacaat

SEQ ID NO: 736378 - DNA, 2922 bp, Homo sapiens
ggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactggtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgaaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagctgtggatttctatcaacagaggccaactgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaattttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgtccatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttacagcaggaatatgagggtttatttgctgtggggtcctcaa

SEQ ID NO: 736379 - DNA, 1865 bp, Homo sapiens
ggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactggtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgaaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagacaattgtagatacttataatcccagggaattccggacc

SEQ ID NO: 736380 - DNA, 582 bp, Homo sapiens
  misc_feature (519)..(519): n is a, c, g, or t
ggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactgagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacactttgngatcggccggcaaaccatactctctcaaccacgttatccaccgcccccgagcgcgagcgccac

SEQ ID NO: 736381 - DNA, 574 bp, Homo sapiens
ggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactgagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacactttggcagcggccagatggcaattagcacgtctgtgggaaaagaacgcgggtgggggaca

SEQ ID NO: 736382 - DNA, 3303 bp, Homo sapiens
ggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactggtactgaagatggatggggatcattaggtttctcttattatattgtcccacaaatatcttaaccgtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgaaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagctgtggatttctatcaacagaggccaactgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaattttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgtccatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttacagccaagttttcaccaaatcacaactatcatcaccaccaaaattttaaaaaacagtagttgactactaaaaagtaatcagtggacaggtcatttatgggatcagtaagcacagtagtgtgattatatctgggaaaacatctacagttgtacagctgtatcctcctcaaaatccggtgaagaatgctatttttctaggctgagcttttgttataaacttaatattcagaaggcaagggttatgatcctgatgtgtcctttttttttgcatttgttaattctgaatgtatttttaacagaatgatttttttgacttactagtgtaatttgcattttaaaaataaatggaaaaatactt

SEQ ID NO: 736383 - DNA, 359 bp, Homo sapiens
  misc_feature (296)..(296): n is a, c, g, or t
cggggaatttgaggccaaaacgctgtgtgattctagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacactttgngatcggccggcaaaccatactctctcaaccacgttatccaccgcccccgagcgcgagcgccac

SEQ ID NO: 736384 - DNA, 369 bp, Homo sapiens
  misc_feature (39)..(39): n is a, c, g, or t
  misc_feature (306)..(306): n is a, c, g, or t
tatccacccacaccatccctacacaccacaaaaacctcnaaactagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacactttgngatcggccggcaaaccatactctctcaaccacgttatccaccgcccccgagcgcgagcgccac

SEQ ID NO: 736385 - DNA, 376 bp, Homo sapiens
  misc_feature (39)..(39): n is a, c, g, or t
  misc_feature (313)..(313): n is a, c, g, or t
ccagtgttccgcgcggcgagcagcacggggacagggggngggggggtcaggagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacactttgngatcggccggcaaaccatactctctcaaccacgttatccaccgcccccgagcgcgagcgccac

SEQ ID NO: 736386 - DNA, 359 bp, Homo sapiens
  misc_feature (26)..(26): n is a, c, g, or t
  misc_feature (296)..(296): n is a, c, g, or t
atactcttacattagaattaaaacanacgttgacagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacactttgngatcggccggcaaaccatactctctcaaccacgttatccaccgcccccgagcgcgagcgccac

SEQ ID NO: 736387 - DNA, 372 bp, Homo sapiens
  misc_feature (309)..(309): n is a, c, g, or t
tcgatataaatgagtttagatcattaagcacgcgccaccccgcttacagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacactttgngatcggccggcaaaccatactctctcaaccacgttatccaccgcccccgagcgcgagcgccac

SEQ ID NO: 736388 - DNA, 716 bp, Homo sapiens
cggcacgagctcgtgccgaatcggcacgagggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactggtgagactgggaacgctgggctggggggccagggtcgggggaattatgtgttcatctgttcatctatctgtccatcctcaaagaggactgagcaccatttatgggcaaagcattgttctaggcgctatagagcaaacaggtgaaagaggcctggtccctgccct

SEQ ID NO: 736389 - DNA, 992 bp, Homo sapiens
ggtccggatttcgggaatcgtcgaccccgcgtccggcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtggggcctcgttctctcacaccccactccatcatctccacccctctaaccatataccaccactccctcttacccttcccagccccactctatctctcacccttcatcttctcacaaccattccacttctctatcctctcacccg

SEQ ID NO: 736390 - DNA, 9847 bp, Homo sapiens
  misc_feature (6073)..(6073): n is a, c, g, or t
aggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggtcagcagatcccctctttgccctatccccagatggctccagaggttcctggagcctgagaaactaccctttgaagattttttttctccccttgtttctcgaggtgtcaccactactatcccaactcaggccccctccacctgcaccctcagaggccctcttagagctgggcactgagcccccaggtaacagcctcacccttccaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttcttttatcgctgtgccgactttcttaggcagggctctccagacctgtacggtggtaagatctgctttctgaaaggaagctgacagcctgagangaaaaccgtatatccccacctgatgccacactctcctcatagaatgtcactctcccctcccaatgagattttttatattttagagcaggagttttgcaccggccaaacttctccaatctaactctcccctcaccactgtgtcacttagtccgaggccaggaacagcggcgttatctgataaaagagttcatgtatatatccacatttatctcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatggtaagtacccaactaatctcgcccctctcaggacctaccgggggcgggtgctacacttaatcaccgggaaacgcagctttccggggcggctgacggcccaccccctccgaccgggctgttctctcccgggccctgcctctcggtcctctgcagcggggaggacttcagcagctccccgggacgcccgttgcgaggacaccctgggcctgtgccctcctactagcaccgccctcctcgtctgcagtagccaatcaacacgaggcttgtaggctgccgttcctcgattggctacggctctagctccgcccgccgcacttggcgacggtgtccggcggggaggcggcggcttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttgtgggcaggtgaaggcaggctggtggctgaaggacctccttcttatcttccacaggggctggaagttaaaacccctgttggtgtttagtggtggtggttgttgttgtttgtttttgctttcttggtgtgcgggactgatttgcagaaaccgccactgacttaaaagtttccagttattgctcgtggggagggggttgtttgagaagatgtggctccctttatccagggcttctgtgacctccatctttttcctctgcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtcgctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaaaaaacagtg

SEQ ID NO: 736391 - DNA, 4651 bp, Homo sapiens
aggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttcccatccagtcttcccactcctctctgcatctcaggaccttctctaccagaaccttggtctttctgcccctagaccccacctagttccaagaacccctgccccttctttgctcactcctattcaagccacgttgttcagcttcctctgcgctcttgggccagagggctagaagctgccgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcctctcttctcacaagccagcttctaggacctcccttctgcacccttaccccttgctttcccaaaattctgctcattttccta

SEQ ID NO: 736392 - DNA, 4653 bp, Homo sapiens
aggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttcccatccagtcttcccactcctctctgcatctcaggaccttctctaccagaaccttggtctttctgcccctagaccccacctagttccaagaacccctgccccttctttgctcactcctattcaagccacgttgttcagcttcctctgcgctcttgggccagagggctagaagctgccgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcagcaccagcacgaattcccttagcaccagcacgaattcccgtggcaccagcacgaattcccttagcaccagcacgaattccctg

SEQ ID NO: 736393 - DNA, 9683 bp, Homo sapiens
  misc_feature (5909)..(5909): n is a, c, g, or t
aggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttcttttatcgctgtgccgactttcttaggcagggctctccagacctgtacggtggtaagatctgctttctgaaaggaagctgacagcctgagangaaaaccgtatatccccacctgatgccacactctcctcatagaatgtcactctcccctcccaatgagattttttatattttagagcaggagttttgcaccggccaaacttctccaatctaactctcccctcaccactgtgtcacttagtccgaggccaggaacagcggcgttatctgataaaagagttcatgtatatatccacatttatctcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatggtaagtacccaactaatctcgcccctctcaggacctaccgggggcgggtgctacacttaatcaccgggaaacgcagctttccggggcggctgacggcccaccccctccgaccgggctgttctctcccgggccctgcctctcggtcctctgcagcggggaggacttcagcagctccccgggacgcccgttgcgaggacaccctgggcctgtgccctcctactagcaccgccctcctcgtctgcagtagccaatcaacacgaggcttgtaggctgccgttcctcgattggctacggctctagctccgcccgccgcacttggcgacggtgtccggcggggaggcggcggcttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttgtgggcaggtgaaggcaggctggtggctgaaggacctccttcttatcttccacaggggctggaagttaaaacccctgttggtgtttagtggtggtggttgttgttgtttgtttttgctttcttggtgtgcgggactgatttgcagaaaccgccactgacttaaaagtttccagttattgctcgtggggagggggttgtttgagaagatgtggctccctttatccagggcttctgtgacctccatctttttcctctgcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtcgctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaaaaaacagtg

SEQ ID NO: 736394 - DNA, 9432 bp, Homo sapiens
  misc_feature (5909)..(5909): n is a, c, g, or t
aggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttcttttatcgctgtgccgactttcttaggcagggctctccagacctgtacggtggtaagatctgctttctgaaaggaagctgacagcctgagangaaaaccgtatatccccacctgatgccacactctcctcatagaatgtcactctcccctcccaatgagattttttatattttagagcaggagttttgcaccggccaaacttctccaatctaactctcccctcaccactgtgtcacttagtccgaggccaggaacagcggcgttatctgataaaagagttcatgtatatatccacatttatctcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatggtaagtacccaactaatctcgcccctctcaggacctaccgggggcgggtgctacacttaatcaccgggaaacgcagctttccggggcggctgacggcccaccccctccgaccgggctgttctctcccgggccctgcctctcggtcctctgcagcggggaggacttcagcagctccccgggacgcccgttgcgaggacaccctgggcctgtgccctcctactagcaccgccctcctcgtctgcagtagccaatcaacacgaggcttgtaggctgccgttcctcgattggctacggctctagctccgcccgccgcacttggcgacggtgtccggcggggaggcggcggcttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttgtgggcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtcgctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaaaaaacagtg

SEQ ID NO: 736395 - DNA, 9106 bp, Homo sapiens
  misc_feature (5583)..(5583): n is a, c, g, or t
aggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccccaccccactcccagccttatctatcccccctcactgtccccttttctccactcccagccccatttcctttttttctggagtgtgtggtgaaacagaaaaaaacatgtttaataaacggagattgttcttttatcgctgtgccgactttcttaggcagggctctccagacctgtacggtggtaagatctgctttctgaaaggaagctgacagcctgagangaaaaccgtatatccccacctgatgccacactctcctcatagaatgtcactctcccctcccaatgagattttttatattttagagcaggagttttgcaccggccaaacttctccaatctaactctcccctcaccactgtgtcacttagtccgaggccaggaacagcggcgttatctgataaaagagttcatgtatatatccacatttatctcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatggtaagtacccaactaatctcgcccctctcaggacctaccgggggcgggtgctacacttaatcaccgggaaacgcagctttccggggcggctgacggcccaccccctccgaccgggctgttctctcccgggccctgcctctcggtcctctgcagcggggaggacttcagcagctccccgggacgcccgttgcgaggacaccctgggcctgtgccctcctactagcaccgccctcctcgtctgcagtagccaatcaacacgaggcttgtaggctgccgttcctcgattggctacggctctagctccgcccgccgcacttggcgacggtgtccggcggggaggcggcggcttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttgtgggcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtcgctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaaaaaacagtg

SEQ ID NO: 736396 - DNA, 4273 bp, Homo sapiens
aggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccgacacctgcacagatccatctcccaagacaccacccaaagagagcatttgctgctgcttcccagaactgtccaacaataccttagcaacaccaagagttgggccctagatgggcccagcacattcacaggtcacacccacttccctgcaaaacccaccccctcccagcctcctcctgactctaagccctcctcttcctctaaa

SEQ ID NO: 736397 - DNA, 1962 bp, Homo sapiens
  misc_feature (1962)..(1962): n is a, c, g, or t
aggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggagggatgagggggatactctagagtgan

SEQ ID NO: 736398 - DNA, 1706 bp, Homo sapiens
aggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcctcccatcttgctcctgcggtc

SEQ ID NO: 736399 - DNA, 2384 bp, Homo sapiens
tacccccaacgggctccccctcacacccaccaatataaccaaaaaggctgcaccggtccggaatcccgggattgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaaaaaacagtg

SEQ ID NO: 736400 - DNA, 933 bp, Homo sapiens
gtttttccagagagctatggggttccatgggcaggctctgagcctgtgcccgccactaaccccactgaagcccgtcccttcaggctgatgctggtggaggaggagctgcgccgggaccaccccgccatggctgagccgctgccagaacccaagaagaggctgctcgacgctcaggtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttcccatccagtcttcccactcctctctgcatctcaggaccttctctaccagaaccttggtctttctgcccctagaccccacctagttccaagaacccctgccccttctttgctcactcctattcaagccacgttgttcagcttcctctgcgctcttgggccagagggctagaagctgccgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcctctcttctcacaagccagcttctaggacctcccttctgcacccttaccccttgctttcccaaaattctgctcattttccta

SEQ ID NO: 736401 - DNA, 6969 bp, Homo sapiens
  misc_feature (3195)..(3195): n is a, c, g, or t
gaccggtccggaattctccggatgtcatcacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttcttttatcgctgtgccgactttcttaggcagggctctccagacctgtacggtggtaagatctgctttctgaaaggaagctgacagcctgagangaaaaccgtatatccccacctgatgccacactctcctcatagaatgtcactctcccctcccaatgagattttttatattttagagcaggagttttgcaccggccaaacttctccaatctaactctcccctcaccactgtgtcacttagtccgaggccaggaacagcggcgttatctgataaaagagttcatgtatatatccacatttatctcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatggtaagtacccaactaatctcgcccctctcaggacctaccgggggcgggtgctacacttaatcaccgggaaacgcagctttccggggcggctgacggcccaccccctccgaccgggctgttctctcccgggccctgcctctcggtcctctgcagcggggaggacttcagcagctccccgggacgcccgttgcgaggacaccctgggcctgtgccctcctactagcaccgccctcctcgtctgcagtagccaatcaacacgaggcttgtaggctgccgttcctcgattggctacggctctagctccgcccgccgcacttggcgacggtgtccggcggggaggcggcggcttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttgtgggcaggtgaaggcaggctggtggctgaaggacctccttcttatcttccacaggggctggaagttaaaacccctgttggtgtttagtggtggtggttgttgttgtttgtttttgctttcttggtgtgcgggactgatttgcagaaaccgccactgacttaaaagtttccagttattgctcgtggggagggggttgtttgagaagatgtggctccctttatccagggcttctgtgacctccatctttttcctctgcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtcgctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaaaaaacagtg

SEQ ID NO: 736402 - DNA, 1866 bp, Homo sapiens
  misc_feature (580)..(580): n is a, c, g, or t
gttcctgctgggtgccgaggtagcgaggtcaggggtcaagagtggaacaccctcactggcccgggccggcgcgggagggctgtgtgatggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctgtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccaggngctggtacagggctgcctcttggacccttcccagcgggaggtgttcctgcagcagatatatgagcagctctgcctctttgaggataaggtggccaccatgctgcagcagcagtacgatccccagagccaggcagaagaccagtccccagactcaggggacctactgggccggaaggtaggcgtctccatggtgacagctgatcttgggctggtcagtatgattcgtcagggcatcttggcactgcagttactaccctcgaactctagtgcagggattatcgtgatcacggatggggtgaccagtgtacctgatgttgctgtctgtgagacactgctgaaccagcttcgcagtggcactgtggcttgttcctttgtccaggtgggaggagtttactcttatgactgcagttttggccatgtgcccaatgtggaattaatgaagttcatcgcaatggcaacatttgggtcctacctgtccacttgtcctgagccggagccaggcaacctgggtctgactgtctaccaccgggcatttctcctctattccttcctgcgcagtggggaagcactgaaccctgaatattactgcggtgagagggctctcagcaccgcctatttaatgagcacctggtctctgcaagcagcaaccctgcctggccttgcgccggaagaagcacactgagaaggaggtgccagccgacttggcagcactgtgtcgtacggcttcgagagggctacagtgtccgagaggtcacactggccaaaggagggtcccaacttggaggtaaagctgggtgcatgcatgtggaaacacaacatgcgcattgagtatgtggctatggcatcctggcccctggagcctgagggccctcgagtaacacgggtggaagtgacgatggaaggcggctacgacattttgcatgatgtgtcctgtgcactaaggcagcccattcgttcattgtatcgtacccatgttatccggcgtttctggaacacgctgcagagcatcaaccagacagaccagatgcttgcccaccttcagtccttctcctcagtgcctgagcatttcacgcttcctgacagcaccaagagcggagtgccactcttctacatccctccaggctccaccaccccggtgctctccctccagcccagtggttctgactcatcccatgcccagtttgctgcctactggaagccagtgctgtccatggatgcaaattcctggcagcgatggctgcacatgcatcgcctggtgctaatcctggagcatgacacgtgggtgc

SEQ ID NO: 736403 - DNA, 2167 bp, Homo sapiens
  misc_feature (881)..(881): n is a, c, g, or t
gttcctgctgggtgccgaggtagcgaggtcaggggtcaagagtggaacaccctcactggcccgggccggcgcgggagggctgtgtgatggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctggtgaggcttagacacacgaaaggtgtgaggggccagcccagaaggatctgttttttaggagagtgctagaaacagacagggtgggagactaactcttaagtctggttagggcaagggactgcctacaagatgatggaaataaaaaataatttttccagagagtgagaggaagagtatacggttagattgagggaggtagagccaatgatgtgtcatttgggatatagaaggcaggtcctgggaagaaagggatacttcgctgatcctttccttttctttccatcctaattttcagcttcagtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccaggngctggtacagggctgcctcttggacccttcccagcgggaggtgttcctgcagcagatatatgagcagctctgcctctttgaggataaggtggccaccatgctgcagcagcagtacgatccccagagccaggcagaagaccagtccccagactcaggggacctactgggccggaaggtaggcgtctccatggtgacagctgatcttgggctggtcagtatgattcgtcagggcatcttggcactgcagttactaccctcgaactctagtgcagggattatcgtgatcacggatggggtgaccagtgtacctgatgttgctgtctgtgagacactgctgaaccagcttcgcagtggcactgtggcttgttcctttgtccaggtgggaggagtttactcttatgactgcagttttggccatgtgcccaatgtggaattaatgaagttcatcgcaatggcaacatttgggtcctacctgtccacttgtcctgagccggagccaggcaacctgggtctgactgtctaccaccgggcatttctcctctattccttcctgcgcagtggggaagcactgaaccctgaatattactgcggtgagagggctctcagcaccgcctatttaatgagcacctggtctctgcaagcagcaaccctgcctggccttgcgccggaagaagcacactgagaaggaggtgccagccgacttggcagcactgtgtcgtacggcttcgagagggctacagtgtccgagaggtcacactggccaaaggagggtcccaacttggaggtaaagctgggtgcatgcatgtggaaacacaacatgcgcattgagtatgtggctatggcatcctggcccctggagcctgagggccctcgagtaacacgggtggaagtgacgatggaaggcggctacgacattttgcatgatgtgtcctgtgcactaaggcagcccattcgttcattgtatcgtacccatgttatccggcgtttctggaacacgctgcagagcatcaaccagacagaccagatgcttgcccaccttcagtccttctcctcagtgcctgagcatttcacgcttcctgacagcaccaagagcggagtgccactcttctacatccctccaggctccaccaccccggtgctctccctccagcccagtggttctgactcatcccatgcccagtttgctgcctactggaagccagtgctgtccatggatgcaaattcctggcagcgatggctgcacatgcatcgcctggtgctaatcctggagcatgacacgtgggtgc

SEQ ID NO: 736404 - DNA, 957 bp, Homo sapiens
gctggtacggccggagagtttgggatctggcccaggcattggaagtcgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtgggctgcgctttgaaccgggtgttacaggatcccaggtcacattgtcccggcattttgcaaacaactgcccagggtgagaacttcctcctcgtgaacctttaaggccacactgtggcactgggaaacccggctcgtgacacaacctcgtatagtgcagacggcccaa

SEQ ID NO: 736405 - DNA, 734 bp, Homo sapiens; identical to SEQ ID NO: 380610

SEQ ID NO: 736406 - DNA, 1516 bp, Homo sapiens
caagcgattctcttgcctcagtctcccaagcagctgagaatacaggcatgcgccaccacgccaggctaattttgtatttttagtagagatggggtttcacctgttggccaggctgatctcgaactcctgacctcaggtgatccacctgcctcgacctcccaaagtgctgggattacaggcatgagccacagcatccagcctgcccatcctttctatagagtctatgctgtgtgtaaaatataagacattttttacaactagtaagcttttatgatataaggtgatttcatatgaagcattcttttttttttttccttcagacaaatgaggcctacatgtaatttgctttacgtagtgagcttggcactgctctagacatcagagataaagaggttaataagacagataagatgctactttttgatttgtaatttcttcatataaggcacagccctggcttaggttctgacacagttactgagatcacctacatcacactgagagaactagtgatatcttttaataatcctgtagtcctttgttcttttgcagtgatgtatatctctcatcaagagacagacaaatacttgattggcattttgcaaatcttgaatttgctaatgccacacctctctcaactctctcccttaagcactgggatcaggtaagtttcccttattgtttattttattgcacatgtctttgggagggattgtaagagaaatagttaattttgtatgtgtgtttttaaacagctttagtaagagacatcatttacatacagtgaaattcacctattttaagtgaacagtttattgatttgccagacttcagtcataagcccccacacaatcagaatatagaacatgcccatcatcctgaaatgttttctcctgcctctttgtagttaatcccccatgctctggctcctggccctggacaaccactgatttgcgttatcactgtaattttgtttattctacagtttcatataaagtgaatcatacagtacatagctttttgtgtgtgatatatttcacttagtatagtttttgagatgtgcatgaagtttttgagattcatcttttttgcctgtatcagtagtttgttccttttaattatttaatagaattccattgtgtggatataccactggtgccttaatgggcatttgggttgtttcccttttttgactgctaatgaacgaagctgcttaagaatgttcatgtctttctcttgagtaaatatttatgaatggaattgctgggtactatggaaagtggatttttaactttataaatcaacttccaaactattttccaaattgccttcccatcagcaatgtatgaaaattccattttctccaaatcctcaccaatcttggtaatgccagtttttaaaatgtcagccattctaataggtatagtagtatttgcatttccctgatgactagtgatgtagagcaactcttcctgagcttatgagccattcatatgtcatctttgagtaaatgtct

SEQ ID NO: 736407 - DNA, 491 bp, Homo sapiens
gacaaaagaaacttccctaatctcactacccgaagatttagggacattttttggtgttttctctttttccttcagtttcctttggtaactgtagctaaatactgagtgatttgttctttagtttgccttaaaatattgactgtttccacaagcttgtgttttcattgttgttgtacagaactaggtgcaaatgacacagattaataaaaggttggaaatatgttcttttctctcctctttaggatgatgactttgagttcactggcagccacctgacagtaaggaatggctactcgtgtgtgcctgtggctttagcagaaggcctagacattaaactgaatacagcagtgcgacaggttcgctacacggcttcaggtatgtcactgctttacaaaaggtaagagagaactctcctgaaacaggactgatcttttgttaggtgcgacctatcaggtacatttcctgatagagtgtttatgacaccataggta

SEQ ID NO: 736408 - DNA, 1136 bp, Homo sapiens
catgtactgagctttcatatttattttgagatatataatttcaaaatatatatagtatataaacagacattcattaaaaaacaaacgaggaaaacgatgttaacataatttcagtaccctctctgaggtcagctttgaactcattcatactctgacaagctgagaatcactgtgcattctcaagcatagcacgctccacagttttaggctgcatcccccagatctgcatcacagccttcttgtagcattcttctgttggtcgatagtgagcagctaaccacagtcagaagacattggttctattgggatgagcactttattctttatttttggtctaaatgtacttaacttgagtaagtggtataaggtcctttcattagtctagatcaccagtgtatcaggagggtagtgtggggatgacagttgaggattctgaagttgactacaagggtttgaatcctggcacttattacgtgtgtagccttagatgagttatttcacctctacctcagttttcttatgtgaaacatgaaggtaatgaaaatagaaaaatgagaattgagaaatggatgtccatctgttgtacactaaatgttcagtgtccttatcagtgccatattcatcaccactagtcttttcccacccaacctctgcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtagcttgccctagacactcctgtctacagatctgatgtacaaatagcagtcttcgttgtttacttggtgaggaggtggccttgcatttttgggcatttggctatgctcccaattgtgacatcagggctgaggcgtgtcagttgattctcttcagtgcctaagtctatcatcaagtgtctgttcatatggacttagtcttatggggtcatttcacaaactcaggcctataaaaaggggatcgtaaatgtcatcctaaataataaggattgctgggcttattttgaaagcaga

SEQ ID NO: 736409 - DNA, 356 bp, Homo sapiens; identical to SEQ ID NO: 380612

SEQ ID NO: 736410 - DNA, 4848 bp, Homo sapiens
gagacgtcatttcactcttgttgcccaggctggagtacaatggtgcgatcttggctcactgcaacctccgcctcctgggttcaagtgattctcctgcctcagcctcctgagtagctgcgattacaggcatgtgccaccacacccagctaattttgtatttttagtagagacggggtttcactatattgtccaggctggtcttgaactcctgaccttgtgatccgcctgccttggcctcccaaagtgctgggattacaggtgtgagccaccacgcctggccagaattctacctttttaatattctccttggttctcccaagcaaatgcagatcaaagaataacataggcatgagtaagaaaggttagcagagtagaaagagcattggatttagagacaggaatcttggattcaagtcttcgctcttccagtaattctgctgggtgaccttaggtaagatattttgtgtttctgacccttagcttctacatctgaaaaatggggataatatctgcccccaggcagatattcaagggactgaataagatagtgggtagtgaagtacttttgtccagtgttaagtaccctgtaaagagtcacagggcttttcaagttaacagagtcatctgcttttttaaagaagggagcactgtgtccaggtccaagaagtttttcatcatcacaggtttctcatcaaaaagacactcccaggggcttctccagatgctgttctgacaccctgagcctcacactcacataaggcaggtggttctggatttatcaaagctgtaatgagctatactgaaccagccctgccctcagactgataatatgagacagacagctgtctggggggcaaaagaaagtgtcacttggaattgggtatacgcttatctaaaataggcccagtgtaagccccggctctcctcatccctgagaggccagcagcctgtgaagatctgctaactgaggcggccgagaacttgctgacctggctccccctcactgtgccctacagaaagggcaccgggcctcctcctgttgcccagagctccccatcagctgcagctgcttcttgtgcttttcatgctgttctgagggcctacggggagctcctttagctgctctggcaaaccaagggaagagaagacagatttcctttttatgtcaccttcatatacgagagcaaaatgaagacaacaaattggaaaagggattttggaaagtgatgctgccaaaaaccttctttaggagaaaggtcaaacccccctgatttttcaacagttctctaaggaacccagttctactcagttctcaagatcctgggtcacacaggccagagcagaggggaaaaaggaaaaggcaaagaaggaaaagggagggagaaaagagagaggggagagaggctggaactcaccatgcttgctgagtggttccaggctgcgacagtgatggtgtctcctacccgattccgacgggtaagcacctctgacacagtgaggctactttgggtccttctggaggagggctcaggggcatcccctgaacttggtcctacccttcgagtgccctgctcaaaaaggcaggacctgggctgttcgagttctgagaagtctgtggaagacctctgggtgtaggcattgctattggtagattccacgtttttacctattcgagttggggggtcttctaaagatttcaagtctcgcctactcttccaggcattccgcacagtaacatgtctggcatctgagaagcccacttctgaaggggcactatggcttttccacctgattgtctccgctggaggtgcatggctattcctctccacaggatccgatggcttgattataatgctgctccgagagaccactgtttctggcctgttcttcaggggcccatctgccattctctccgcttctgcaagctgcagggtgatgtcatgtttgtgaatggagagctcaaaaggggagctgacatggttgctaactgatgtgagctctgccagccccacctggatattgctagtggatgtgtgcctctccctcagggcctcacccggagcagctctggggctgctgctgtcagatggatatatagtaatgctacttgtcactttgtttggccctggtttggagacgggtttctgtttctccaacgtagtctctgttccagatcctcccatgatttttttcacatccttatcaacaataacaggtttgatgatggctctagaccgcaacgcctctctggggctaaagggcctttggctttttaccccagcaccattggtatctgggagctccatggtattggtggaggctctgacagatttcacagattcattctccattccagcatctttatcattctcaaatagggaggttctaggtgcccctcgggttttagccttttctctagagttaggctgtggtttgggctctggctctggagtgatggttgtatttaccaacttggcagtaacaagagatgctatgtccaagtcatcatctgagtctggcttctctctgccactggatttgatgactcgacacctcaaggcttcatgcggactgctgtcttccatcacaactgctgcaggttgattaaccccttctttatgtgaggttgaaaatccctgaaggatgttctcttggcttctacagctataaggatacttcgatagaacaggagccttggaattcgggcaactgttatcagcctcaaggccattggcagcctttttgcctttagagagcccttctgaggaggatcttcgagatgaggccagggctccaatggccttagaacagccagagtttgcagcctgagttacttgacttccgttgccaagcacgtgtcccctcttgccaaagacagtctcagaggaggtgtcagaagccttgtcagctctacccaatgggtcactgggaacagatccatgggtggtgtcactaaacgttcgtgttgtcttctccacttttcccttcagtccactctcggtgcctggcttggaagtccccttccacgctttactgtgctcctgagcagccggggggtagcgactcagcactgagggctgctccctagacttcttcccttcgctcttggaggagctgggtacaaaccggtcttcagttttctttgtctcctgagtcccactgtctgtactcacccccatgtgagaagcttttgctgccctcctgttggtgaaactgggagaagaaacctgcctgttgctcagagaatagttttcattgttgagagcaaactccctgttccggagtcgttcccgcttatgctgaggagacagttcccgcgctgtgtgcttggacacagaagcttcacttccgtggcctctaaacttagtcctctcatgtctgcctttgctggacaggaaagcatcttccccttctacctctccattttctaactctttctgtttcttgatttgtagctttatctcctccagttggctggctaataatttgtttttattttgttcacttaggtaattatcctgaaggtcgttatttttggacttcattttcttaagctcttcttccaacgattcaaagtgtttgatttgcgtcttaagtttctcaatctcttggttaaggtctttgactttgttgtcttcctgattgcggttcttttcattttctgatttgtttcttgtttcattctctacctgctttaggtagtccagaccacccttccttcttgattctttggacggcagtgtggaagagatgccatcctcaatccgtaggtcatttctttccagattagaagcattccttgtataatctcggttcatttttttgttctgctctagtttttgagtgagttcttttatcaatttctcattttctttctccttttcattcaagtattttctctcacttacaaagctcagagttaatgatttcagcttttctaactctgacgctaaactctgctcagttttatccaggcggtcctcagaagattctagttctttcactttgactctgagcatttccagctcagaggagattttcttggtcagatttctctcctcattcaggctcagacacagctgggtacagtcattcttactcctgctgaaggcctcttctagcttctctaattcagccattcgtttctgaagccgctcaatctcagatttcagctcccgggtgaggttttcttcctcttcaagtttctccttcatcagacgacacagatcctctgctctcttaatttcctcgtctttgccttcaattctcagcacccgctggcgcagcacttcaatctccgccaacatgctggagttgctaccttctgcctgaatcaccttgtcctggagatccaggagttcatcctctgctttctggaggttttttgtggcttcctccaactcatcaaggcggcggcttagactctgtagcttaaaccgcaagtggcggctggaggccgtctccttgtagcttgtaaattcggccatgtctactgccagccaatgtgggctcctagaggcatccaattccactcaaggggatgagaaatggttacctttctcttggcaaccacaatcttctttgacagctggagaccatcatcaatcatgtaggtaattcaagctttccgtcaatacttccggcggctctccctatgcttgctgttttggaaacagtcactcactctctttcaaaggcagttgtctcttgacctgatctcatctgataggtcgcagtcaaaatacaggcacacaatactcaggtttattcaatgtcccctctgcggccccgaaccgcgctcccgccagcgaagggttccgccgctcagctgccagcgaccctcgtgcc

SEQ ID NO: 736411 - DNA, 1210 bp, Homo sapiens
gcaggttagcattttattagataaaaacaggaaggagggtgcctggactacctgctttaggtagtccagaccacccttccttcttgattctttggacggcagtgtggaagagatgccatcctcaatccgtaggtcatttctttccagattagaagcattccttgtataatctcggttcatttttttgttctgctctagtttttgagtgagttcttttatcaatttctcattttctttctccttttcattcaagtattttctctcacttacaaagctcagagttaatgatttcagcttttctaactctgacgctaaactctgctcagttttatccaggcggtcctcagaagattctagttctttcactttgactctgagcatttccagctcagaggagattttcttggtcagatttctctcctcattcaggctcagacacagctgggtacagtcattcttactcctgctgaaggcctcttctagcttctctaattcagccattcgtttctgaagccgctcaatctcagatttcagctcccgggtgaggttttcttcctcttcaagtttctccttcatcagacgacacagatcctctgctctcttaatttcctcgtctttgccttcaattctcagcacccgctggcgcagcacttcaatctccgccaacatgctggagttgctaccttctgcctgaatcaccttgtcctggagatccaggagttcatcctctgctttctggaggttttttgtggcttcctccaactcatcaaggcggcggcttagactctgtagcttaaaccgcaagtggcggctggaggccgtctccttgtagcttgtaaattcggccatgtctactgccagccaatgtgggctcctagaggcatccaattccactcaaggggatgagaaatggttacctttctcttggcaaccacaatcttctttgacagctggagaccatcatcaatcatgtaggtaattcaagctttccgtcaatacttccggcggctctccctatgcttgctgttttggaaacagtcactcactctctttcaaaggcagttgtctcttgacctgatctcatctgataggtcgcagtcaaaatacaggcacacaatactcaggtttattcaatgtcccctctgcggccccgaaccgcgctcccgccagcgaagggttccgccgctcagctgccagcgaccctcgtgcc

SEQ ID NO: 736412 - DNA, 338 bp, Homo sapiens
ctggatagaatataaacagaatggaagagataggtaatgcatgaatcataccaagactgaggtgacccagagggctgtcccaaagactttcacatacaattcactgtcagcaaggggccaaggtaagatctgcatctagatcctgacactaaaggaacctggctaagctggctatgtctctctcaggaaagtcaagaaagaatttggctgtaggagacttcccctttcctataagatgatatggtcctagggtagaacccactgtctttgcttaaattaaaacacccgaacattcctcaacagtctaaaaatgtacatgacatcttacagctaggaag

SEQ ID NO: 736413 - DNA, 413 bp, Homo sapiens
aactataatcacaaccgccagtgtaataattgattcaagctaagattatcagtggatgctaaaaccatttggttggaaaataggatatttatactctctcaaagtcaccgtacagatttctcacaaagggaagtagggatccctacaacggaaagataaaacttaccatcaacaatgagacagactgggcgcagtggctcatgcctgtaatcccagcactctggaaggccgaggcgagtggatgacttgaagtcaggagtttgagaacagcctggccaaaatggtgaaaccctgtttctactaaaaatacaaaaattagccaggcatggtggcacacacttgtcatcccagcttcttgggaggctgaggcgggaggatcacttgaacctaggagggggaggctgcagtgagcc

SEQ ID NO: 736414 - DNA, 12028 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgagggtggcattagatgcttgccacttagtagcaagagccgccaagtaggaattgatgcttgcaagtgtttttggctgtggtatccacattttagccagaagcgcagatgtcctttgctttcttcgttaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacacccaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagcctcctcactgccaaatctgatacagacaagggcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgcagactgggaaacaggcccacggagcttctctgagctcatccccatgagattaaaacatacagaaactaaaaaacaaggcccagaaaaacaattgagggcaggagggaagaacccacacggatgataccttccacaagcaaaaatcatcccatactattatagatggtgaaaacaggagaaccttagaataccagatttggtgcccttagagatcatccatttcaaagaactcattttacagacagggaaactgaggctccaagaagacaatgactcacccaaggtcacacagcaaggaagtaaagccatggggaaaaaaatccagcttaccagactggtagtttaatgttctctcattctgagggcaatagtgtctacttcataaaggtagcctttgaaagaggatcccttctttgaattgacagaatgctaaagaaaaagcactgccaagaatatacaattcttttcaacttccccatgtgactggtataaggaacctaaccaatttatttacgtggctttctgaaaagtttgctgcattttgaactatataaagctgaggccctcaatgcgtatgtacgtatcacctttcctccagcgaagtcatcatgatagtcgacttgcagaaatccggggcccacttctgtaggaatgcatcagcttggtaaagtgcgatgcctcctccatgggggatggagaaggaggaacaggagggagtagtctcacagtccatgcctctcatggagctattgcttgtggagtgactaaaggggtctgctttccctcttgctgggcacttcctagaaggcagaggatgctgggtcaggcccagcttagcctagggattttcccaaggtggaaacaatgaagtcagcttgaagtctccagccactggagagaaagcaggcgatgccagcagcattactggtgctcaggaaaggagatgcatgaggcttgcacctccaggtgcctttggaaggtgagcagagagagctggggttggggagggatgatgtcattccaatgggtatccgcatgagtatctgcatgctctgcttccaggagactggtaagccaggagcaggtcaaacttcaacctaaagggtagtctcataatcctttagaggcagcacagacccctttctgctttaagtctgaagaaaagaactccaaggggaaagaaatgaaagccccctagatagagctgatggctggtaaatcttatggggtacttgagcccattgggcaaatgaggagtgaagtggatatagtgaggagactgagaaaccagaacattaaccacacagacagaggctgccctaggatccagaaacaacccaccaaggagccgagaagaatttttgactcctgctgtgtgctggggactttatcttcccttgtttgggggccagaatggtccaactacttggtggacagggacaaggagagagagaggactcgtgcattggggaaggttgggcctgggtgactgtccagcttgtagtctctgattccctctggccaaatggcaaaaattacctgagccacagcccggctctaccacagttttccagccaaggcttgtgtcttgcctggttaactggccttggatccttcgtggggcaggacggtggaagagctgagaagcaggagcagagggcagacaacagacacccagcgggctcagttctcctcagcacagggcctggttggccgtaatcgttcctcggcccgtactcgcccagactctggcagcccctgcttcccaggcagttcagacggatccagggagttgtgcagttgcctgtagacactgagtgtacagtcttccccttcttcctccatgcttgctgagtggttccaggctgcgacagtgatggtgtctcctacccgattccgacgggtaagcacctctgacacagtgaggctactttgggtccttctggaggagggctcaggggcatcccctgaacttggtcctacccttcgagtgccctgctcaaaaaggcaggacctgggctgttcgagttctgagaagtctgtggaagacctctgggtgtaggcattgctattggtagattccacgtttttacctattcgagttggggggtcttctaaagatttcaagtctcgcctactcttccaggcattccgcacagtaacatgtctggcatctgagaagcccacttctgaaggggcactatggcttttccacctgattgtctccgctggaggtgcatggctattcctctccacaggatccgatggcttgattataatgctgctccgagagaccactgtttctggcctgttcttcaggggcccatctgccattctctccgcttctgcaagctgcagggtgatgtcatgtttgtgaatggagagctcaaaaggggagctgacatggttgctaactgatgtgagctctgccagccccacctggatattgctagtggatgtgtgcctctccctcagggcctcacccggagcagctctggggctgctgctgtcagatggatatatagtaatgctacttgtcactttgtttggccctggtttggagacgggtttctgtttctccaacgtagtctctgttccagatcctcccatgatttttttcacatccttatcaacaataacaggtttgatgatggctctagaccgcaacgcctctctggggctaaagggcctttggctttttaccccagcaccattggtatctgggagctccatggtattggtggaggctctgacagatttcacagattcattctccattccagcatctttatcattctcaaatagggaggttctaggtgcccctcgggttttagccttttctctagagttaggctgtggtttgggctctggctctggagtgatggttgtatttaccaacttggcagtaacaagagatgctatgtccaagtcatcatctgagtctggcttctctctgccactggatttgatgactcgacacctcaaggcttcatgcggactgctgtcttccatcacaactgctgcaggttgattaaccccttctttatgtgaggttgaaaatccctgaaggatgttctcttggcttctacagctataaggatacttcgatagaacaggagccttggaattcgggcaactgttatcagcctcaaggccattggcagcctttttgcctttagagagcccttctgaggaggatcttcgagatgaggccagggctccaatggccttagaacagccagagtttgcagcctgagttacttgacttccgttgccaagcacgtgtcccctcttgccaaagacagtctcagaggaggtgtcagaagccttgtcagctctacccaatgggtcactgggaacagatccatgggtggtgtcactaaacgttcgtgttgtcttctccacttttcccttcagtccactctcggtgcctggcttggaagtccccttccacgctttactgtgctcctgagcagccggggggtagcgactcagcactgagggctgctccctagacttcttcccttcgctcttggaggagctgggtacaaaccggtcttcagttttctttgtctcctgagtcccactgtctgtactcacccccatgtgagaagcttttgctgccctcctgttggtgaaactgggagaagaaacctgcctgttgctcagagaatagttttcattgttgagagcaaactccctgttccggagtcgttcccgcttatgctgaggagacagttcccgcgctgtgtgcttggacacagaagcttcacttccgtggcctctaaacttagtcctctcatgtctgcctttgctggacaggaaagcatcttccccttctacctctccattttctaactctttctgtttcttgatttgtagctttatctcctccagttggctggctaataatttgtttttattttgttcacttaggtaattatcctgaaggtcgttatttttggacttcattttcttaagctcttcttccaacgattcaaagtgtttgatttgcgtcttaagtttctcaatctcttggttaaggtctttgactttgttgtcttcctgattgcggttcttttcattttctgatttgtttcttgtttcattctctacctgctttaggtagtccagaccacccttccttcttgattctttggacggcagtgtggaagagatgccatcctcaatccgtaggtcatttctttccagattagaagcattccttgtataatctcggttcatttttttgttctgctctagtttttgagtgagttcttttatcaatttctcattttctttctccttttcattcaagtattttctctcacttacaaagctcagagttaatgatttcagcttttctaactctgacgctaaactctgctcagttttatccaggcggtcctcagaagattctagttctttcactttgactctgagcatttccagctcagaggagattttcttggtcagatttctctcctcattcaggctcagacacagctgggtacagtcattcttactcctgctgaaggcctcttctagcttctctaattcagccattcgtttctgaagccgctcaatctcagatttcagctcccgggtgaggttttcttcctcttcaagtttctccttcatcagacgacacagatcctctgctctcttaatttcctcgtctttgccttcaattctcagcacccgctggcgcagcacttcaatctccgccaacatgctggagttgctaccttctgcctgaatcaccttgtcctggagatccaggagttcatcctctgctttctggaggttttttgtggcttcctccaactcatcaaggcggcggcttagactctgtagcttaaaccgcaagtggcggctggaggccgtctccttgtagcttgtaaattcggccatgtctactgccagccaatgtgggctcctagaggcatccaattccactcaaggggatgagaaatggttacctttctcttggcaaccacaatcttctttgacagctggagaccatcatcaatcatgtaggtaattcaagctttccgtcaatacttccggcggctctccctatgcttgctgttttggaaacagtcactcactctctttcaaaggcagttgtctcttgacctgatctcatctgataggtcgcagtcaaaatacaggcacacaatactcaggtttattcaatgtcccctctgcggccccgaaccgcgctcccgccagcgaagggttccgccgctcagctgccagcgaccctcgtgcc

SEQ ID NO: 736415 - DNA, 12171 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgagggtggcattagatgcttgccacttagtagcaagagccgccaagtaggaattgatgcttgcaagtgtttttggctgtggtatccacattttagccagaagcgcagatgtcctttgctttcttcgttaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacacccaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagcctcctcactgccaaatctgatacagacaagggcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgcagactgggaaacaggcccacggagcttctctgagctcatccccatgagattaaaacatacagaaactaaaaaacaaggcccagaaaaacaattgagggcaggagggaagaacccacacggatgataccttccacaagcaaaaatcatcccatactattatagatggtgaaaacaggagaaccttagaataccagatttggtgcccttagagatcatccatttcaaagaactcattttacagacagggaaactgaggctccaagaagacaatgactcacccaaggtcacacagcaaggaagtaaagccatggggaaaaaaatccagcttaccagactggtagtttaatgttctctcattctgagggcaatagtgtctacttcataaaggtagcctttgaaagaggatcccttctttgaattgacagaatgctaaagaaaaagcactgccaagaatatacaattcttttcaacttccccatgtgactggtataaggaacctaaccaatttatttacgtggctttctgaaaagtttgctgcattttgaactatataaagctgaggccctcaatgcgtatgtacgtatcacctttcctccagcgaagtcatcatgatagtcgacttgcagaaatccggggcccacttctgtaggaatgcatcagcttggtaaagtgcgatgcctcctccatgggggatggagaaggaggaacaggagggagtagtctcacagtccatgcctctcatggagctattgcttgtggagtgactaaaggggtctgctttccctcttgctgggcacttcctagaaggcagaggatgctgggtcaggcccagcttagcctagggattttcccaaggtggaaacaatgaagtcagcttgaagtctccagccactggagagaaagcaggcgatgccagcagcattactggtgctcaggaaaggagatgcatgaggcttgcacctccaggtgcctttggaaggtgagcagagagagctggggttggggagggatgatgtcattccaatgggtatccgcatgagtatctgcatgctctgcttccaggagactggtaagccaggagcaggtcaaacttcaacctaaagggtagtctcataatcctttagaggcagcacagacccctttctgctttaagtctgaagaaaagaactccaaggggaaagaaatgaaagccccctagatagagctgatggctggtaaatcttatggggtacttgagcccattgggcaaatgaggagtgaagtggatatagtgaggagactgagaaaccagaacattaaccacacagacagaggctgccctaggatccagaaacaacccaccaaggagccgagaagaatttttgactcctgctgtgtgctggggactttatcttcccttgtttgggggccagaatggtccaactacttggtggacagggacaaggagagagagaggactcgtgcattggggaaggttgggcctgggtgactgtccagcttgtagtctctgattccctctggccaaatggcaaaaattacctgagccacagcccggctctaccacagttttccagccaaggcttgtgtcttgcctggttaactggccttggatccttcgtggggcaggacggtggaagagctgagaagcaggagcagagggcagacaacagacacccagcgggctcagttctcctcagcacagggcctggttggccgtaatcgttcctcggcccgtactcgcccagactctggcagcccctgcttcccaggcagttcagacggatccagggagttgtgcagttgcctgtagacactgagtgtacagtcttccccttcttcctccatgcttgctgagtggttccaggctgcgacagtgatggtgtctcctacccgattccgacgggtaagcacctctgacacagtgaggctactttgggtccttctggaggagggctcaggggcatcccctgaacttggtcctacccttcgagtgccctgctcaaaaaggcaggacctgggctgttcgagttctgagaagtctgtggaagacctctgggtgtaggcattgctattggtagattccacgtttttacctattcgagttggggggtcttctaaagatttcaagtctcgcctactcttccaggcattccgcacagtaacatgtctggcatctgagaagcccacttctgaaggggcactatggcttttccacctgattgtctccgctggaggtgcatggctattcctctccacaggatccgatggcttgattataatgctgctccgagagaccactgtttctggcctgttcttcaggggcccatctgccattctctccgcttctgcaagctgcagggtgatgtcatgtttgtgaatggagagctcaaaaggggagctgacatggttgctaactgatgtgagctctgccagccccacctggatattgctagtggatgtgtgcctctccctcagggcctcacccggagcagctctggggctgctgctgtcagatggatatatagtaatgctacttgtcactttgtttggccctggtttggagacgggtttctgtttctccaacgtagtctctgttccagatcctcccatgatttttttcacatccttatcaacaataacaggtttgatgatggctctagaccgcaacgcctctctggggctaaagggcctttggctttttaccccagcaccattggtatctgggagctccatggtattggtggaggctctgacagatttcacagattcattctccattccagcatctttatcattctcaaatagggaggttctaggtgcccctcgggttttagccttttctctagagttaggctgtggtttgggctctggctctggagtgatggttgtatttaccaacttggcagtaacaagagatgctatgtccaagtcatcatctgagtctggcttctctctgccactggatttgatgactcgacacctcaaggcttcatgcggactgctgtcttccatcacaactgctgcaggttgattaaccccttctttatgtgaggttgaaaatccctgaaggatgttctcttggcttctacagctataaggatacttcgatagaacaggagccttggaattcgggcaactgttatcagcctcaaggccattggcagcctttttgcctttagagagcccttctgaggaggatcttcgagatgaggccagggctccaatggccttagaacagccagagtttgcagcctgagttacttgacttccgttgccaagcacgtgtcccctcttgccaaagacagtctcagaggaggtgtcagaagccttgtcagctctacccaatgggtcactgggaacagatccatgggtggtgtcactaaacgttcgtgttgtcttctccacttttcccttcagtccactctcggtgcctggcttggaagtccccttccacgctttactgtgctcctgagcagccggggggtagcgactcagcactgagggctgctccctagacttcttcccttcgctcttggaggagctgggtacaaaccggtcttcagttttctttgtctcctgagtcccactgtctgtactcacccccatgtgagaagcttttgctgccctcctgttggtgaaactgggagaagaaacctgcctgttgctcagagaatagttttcattgttgagagcaaactccctgttccggagtcgttcccgcttatgctgaggagacagttcccgcgctgtgtgcttggacacagaagcttcacttccgtggcctctaaacttagtcctctcatgtctgcctttgctggacaggaaagcatcttccccttctacctctccattttctaactctttctgtttcttgatttgtagctttatctcctccagttggctggctaataatttgtttttattttgttcacttaggtaattatcctgaaggtcgttatttttggacttcattttcttaagctcttcttccaacgattcaaagtgtttgatttgcgtcttaagtttctcaatctcttggttaaggtctttgactttgttgtcttcctgattgcggttcttttcattttctgatttgtttcttgtttcattctctacctgctttaggtagtccagaccacccttccttcttgattctttggacggcagtgtggaagagatgccatcctcaatccgtaggtcatttctttccagattagaagcattccttgtataatctcggttcatttttttgttctgctctagtttttgagtgagttcttttatcaatttctcattttctttctccttttcattcaagtattttctctcacttacaaagctcagagttaatgatttcagcttttctaactctgacgctaaactctgctcagttttatccaggcggtcctcagaagattctagttctttcactttgactctgagcatttccagctcagaggagattttcttggtcagatttctctcctcattcaggctcagacacagctgggtacagtcattcttactcctgctgaaggcctcttctagcttctctaattcagccattcgtttctgaagccgctcaatctcagatttcagctcccgggtgaggttttcttcctcttcaagtttctccttcatcagacgacacagatcctctgctctcttaatttcctcgtctttgccttcaattctcagcacccgctggcgcagcacttcaatctccgccaacatgctggagttgctaccttctgcctgaatcaccttgtcctggagatccaggagttcatcctctgctttctggaggttttttgtggcttcctccaactcatcaaggcggcggcttagactctgtagcttaaaccgcaagtggcggctggaggccgtctccttgtagcttgtaaattcggccatgtctactgccagccaatgtgggctcctagaggcatccaattccactcaaggggatgagaaatggttacctttctcttggcaaccacaatcttctttgacagctggagaccatcatcaatcatgtaggtaattcaagctttccgtcaatacttccggcggctctccctatgcttgctgttttggaaacagtcactcactctctttcaaaggcagttgtctcttgacctgatctcatctgataggtcgcagtcaaaatacaggcacacaatactcaggtttattcaatgtccccatcaacaatgagacagactgggcgcagtggctcatgcctgtaatcccagcacttttgggaggataaggtgggaggattgcttgagctcaggagtttgagaccagcctgggcaacaaagtgagaccttgtctctacaaaaaataaaaaaataaaattagctgggcatggtggtgggcacccagctactcgggaggctgaggcaggagaatcac

SEQ ID NO: 736416 - DNA, 11962 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgagggtggcattagatgcttgccacttagtagcaagagccgccaagtaggaattgatgcttgcaagtgtttttggctgtggtatccacattttagccagaagcgcagatgtcctttgctttcttcgttaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacacccaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagcctcctcactgccaaatctgatacagacaagggcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgcagactgggaaacaggcccacggagcttctctgagctcatccccatgagattaaaacatacagaaactaaaaaacaaggcccagaaaaacaattgagggcaggagggaagaacccacacggatgataccttccacaagcaaaaatcatcccatactattatagatggtgaaaacaggagaaccttagaataccagatttggtgcccttagagatcatccatttcaaagaactcattttacagacagggaaactgaggctccaagaagacaatgactcacccaaggtcacacagcaaggaagtaaagccatggggaaaaaaatccagcttaccagactggtagtttaatgttctctcattctgagggcaatagtgtctacttcataaaggtagcctttgaaagaggatcccttctttgaattgacagaatgctaaagaaaaagcactgccaagaatatacaattcttttcaacttccccatgtgactggtataaggaacctaaccaatttatttacgtggctttctgaaaagtttgctgcattttgaactatataaagctgaggccctcaatgcgtatgtacgtatcacctttcctccagcgaagtcatcatgatagtcgacttgcagaaatccggggcccacttctgtaggaatgcatcagcttggtaaagtgcgatgcctcctccatgggggatggagaaggaggaacaggagggagtagtctcacagtccatgcctctcatggagctattgcttgtggagtgactaaaggggtctgctttccctcttgctgggcacttcctagaaggcagaggatgctgggtcaggcccagcttagcctagggattttcccaaggtggaaacaatgaagtcagcttgaagtctccagccactggagagaaagcaggcgatgccagcagcattactggtgctcaggaaaggagatgcatgaggcttgcacctccaggtgcctttggaaggtgagcagagagagctggggttggggagggatgatgtcattccaatgggtatccgcatgagtatctgcatgctctgcttccaggagactggtaagccaggagcaggtcaaacttcaacctaaagggtagtctcataatcctttagaggcagcacagacccctttctgctttaagtctgaagaaaagaactccaaggggaaagaaatgaaagccccctagatagagctgatggctggtaaatcttatggggtacttgagcccattgggcaaatgaggagtgaagtggatatagtgaggagactgagaaaccagaacattaaccacacagacagaggctgccctaggatccagaaacaacccaccaaggagccgagaagaatttttgactcctgctgtgtgctggggactttatcttcccttgtttgggggccagaatggtccaactacttggtggacagggacaaggagagagagaggactcgtgcattggggaaggttgggcctgggtgactgtccagcttgtagtctctgattccctctggccaaatggcaaaaattacctgagccacagcccggctctaccacagttttccagccaaggcttgtgtcttgcctggttaactggccttggatccttcgtggggcaggacggtggaagagctgagaagcaggagcagagggcagacaacagacacccagcgggctcagttctcctcagcacagggcctggttggccgtaatcgttcctcggcccgtactcgcccagactctggcagcccctgcttcccaggcagttcagacggatccagggagttgtgcagttgcctgtagacactgagtgtacagtcttccccttcttcctccatgcttgctgagtggttccaggctgcgacagtgatggtgtctcctacccgattccgacgggtaagcacctctgacacagtgaggctactttgggtccttctggaggagggctcaggggcatcccctgaacttggtcctacccttcgagtgccctgctcaaaaaggcaggacctgggctgttcgagttctgagaagtctgtggaagacctctgggtgtaggcattgctattggtagattccacgtttttacctattcgagttggggggtcttctaaagatttcaagtctcgcctactcttccaggcattccgcacagtaacatgtctggcatctgagaagcccacttctgaaggggcactatggcttttccacctgattgtctccgctggaggtgcatggctattcctctccacaggatccgatggcttgattataatgctgctccgagagaccactgtttctggcctgttcttcaggggcccatctgccattctctccgcttctgcaagctgcagggtgatgtcatgtttgtgaatggagagctcaaaaggggagctgacatggttgctaactgatgtgagctctgccagccccacctggatattgctagtggatgtgtgcctctccctcagggcctcacccggagcagctctggggctgctgctgtcagatggatatatagtaatgctacttgtcactttgtttggccctggtttggagacgggtttctgtttctccaacgtagtctctgttccagatcctcccatgatttttttcacatccttatcaacaataacaggtttgatgatggctctagaccgcaacgcctctctggggctaaagggcctttggctttttaccccagcaccattggtatctgggagctccatggtattggtggaggctctgacagatttcacagattcattctccattccagcatctttatcattctcaaatagggaggttctaggtgcccctcgggttttagccttttctctagagttaggctgtggtttgggctctggctctggagtgatggttgtatttaccaacttggcagtaacaagagatgctatgtccaagtcatcatctgagtctggcttctctctgccactggatttgatgactcgacacctcaaggcttcatgcggactgctgtcttccatcacaactgctgcaggttgattaaccccttctttatgtgaggttgaaaatccctgaaggatgttctcttggcttctacagctataaggatacttcgatagaacaggagccttggaattcgggcaactgttatcagcctcaaggccattggcagcctttttgcctttagagagcccttctgaggaggatcttcgagatgaggccagggctccaatggccttagaacagccagagtttgcagcctgagttacttgacttccgttgccaagcacgtgtcccctcttgccaaagacagtctcagaggaggtgtcagaagccttgtcagctctacccaatgggtcactgggaacagatccatgggtggtgtcactaaacgttcgtgttgtcttctccacttttcccttcagtccactctcggtgcctggcttggaagtccccttccacgctttactgtgctcctgagcagccggggggtagcgactcagcactgagggctgctccctagacttcttcccttcgctcttggaggagctgggtacaaaccggtcttcagttttctttgtctcctgagtcccactgtctgtactcacccccatgtgagaagcttttgctgccctcctgttggtgaaactgggagaagaaacctgcctgttgctcagagaatagttttcattgttgagagcaaactccctgttccggagtcgttcccgcttatgctgaggagacagttcccgcgctgtgtgcttggacacagaagcttcacttccgtggcctctaaacttagtcctctcatgtctgcctttgctggacaggaaagcatcttccccttctacctctccattttctaactctttctgtttcttgatttgtagctttatctcctccagttggctggctaataatttgtttttattttgttcacttaggtaattatcctgaaggtcgttatttttggacttcattttcttaagctcttcttccaacgattcaaagtgtttgatttgcgtcttaagtttctcaatctcttggttaaggtctttgactttgttgtcttcctgattgcggttcttttcattttctgatttgtttcttgtttcattctctacctgctttaggtagtccagaccacccttccttcttgattctttggacggcagtgtggaagagatgccatcctcaatccgtaggtcatttctttccagattagaagcattccttgtataatctcggttcatttttttgttctgctctagtttttgagtgagttcttttatcaatttctcattttctttctccttttcattcaagtattttctctcacttacaaagctcagagttaatgatttcagcttttctaactctgacgctaaactctgctcagttttatccaggcggtcctcagaagattctagttctttcactttgactctgagcatttccagctcagaggagattttcttggtcagatttctctcctcattcaggctcagacacagctgggtacagtcattcttactcctgctgaaggcctcttctagcttctctaattcagccattcgtttctgaagccgctcaatctcagatttcagctcccgggtgaggttttcttcctcttcaagtttctccttcatcagacgacacagatcctctgctctcttaatttcctcgtctttgccttcaattctcagcacccgctggcgcagcacttcaatctccgccaacatgctggagttgctaccttctgcctgaatcaccttgtcctggagatccaggagttcatcctctgctttctggaggttttttgtggcttcctccaactcatcaaggcggcggcttagactctgtagcttaaaccgcaagtggcggctggaggccgtctccttgtagcttgtaaattcggccatgtctactgccagccaatgtgggctcctagaggcatccaattccactcaaggggatgagaaatggttacctttctcttggcaaccacaatcttctttgacagctggagaccatcatcaatcatgtaggtaattcaagctttccgtcaatacttccggcggctctccctatgcttgctgttttggaaacagtcactcactctctttcaaaggcagttgtctcttgacctctgcggccccgaaccgcgctcccgccagcgaagggttccgccgctcagctgccagcgaccctcgtgcc

SEQ ID NO: 736417 - DNA, 11883 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgagggtggcattagatgcttgccacttagtagcaagagccgccaagtaggaattgatgcttgcaagtgtttttggctgtggtatccacattttagccagaagcgcagatgtcctttgctttcttcgttaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacacccaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagcctcctcactgccaaatctgatacagacaagggcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgcagactgggaaacaggcccacggagcttctctgagctcatccccatgagattaaaacatacagaaactaaaaaacaaggcccagaaaaacaattgagggcaggagggaagaacccacacggatgataccttccacaagcaaaaatcatcccatactattatagatggtgaaaacaggagaaccttagaataccagatttggtgcccttagagatcatccatttcaaagaactcattttacagacagggaaactgaggctccaagaagacaatgactcacccaaggtcacacagcaaggaagtaaagccatggggaaaaaaatccagcttaccagactggtagtttaatgttctctcattctgagggcaatagtgtctacttcataaaggtagcctttgaaagaggatcccttctttgaattgacagaatgctaaagaaaaagcactgccaagaatatacaattcttttcaacttccccatgtgactggtataaggaacctaaccaatttatttacgtggctttctgaaaagtttgctgcattttgaactatataaagctgaggccctcaatgcgtatgtacgtatcacctttcctccagcgaagtcatcatgatagtcgacttgcagaaatccggggcccacttctgtaggaatgcatcagcttggtaaagtgcgatgcctcctccatgggggatggagaaggaggaacaggagggagtagtctcacagtccatgcctctcatggagctattgcttgtggagtgactaaaggggtctgctttccctcttgctgggcacttcctagaaggcagaggatgctgggtcaggcccagcttagcctagggattttcccaaggtggaaacaatgaagtcagcttgaagtctccagccactggagagaaagcaggcgatgccagcagcattactggtgctcaggaaaggagatgcatgaggcttgcacctccaggtgcctttggaaggtgagcagagagagctggggttggggagggatgatgtcattccaatgggtatccgcatgagtatctgcatgctctgcttccaggagactggtaagccaggagcaggtcaaacttcaacctaaagggtagtctcataatcctttagaggcagcacagacccctttctgctttaagtctgaagaaaagaactccaaggggaaagaaatgaaagccccctagatagagctgatggctggtaaatcttatggggtacttgagcccattgggcaaatgaggagtgaagtggatatagtgaggagactgagaaaccagaacattaaccacacagacagaggctgccctaggatccagaaacaacccaccaaggagccgagaagaatttttgactcctgctgtgtgctggggactttatcttcccttgtttgggggccagaatggtccaactacttggtggacagggacaaggagagagagaggactcgtgcattggggaaggttgggcctgggtgactgtccagcttgtagtctctgattccctctggccaaatggcaaaaattacctgagccacagcccggctctaccacagttttccagccaaggcttgtgtcttgcctggttaactggccttggatccttcgtggggcaggacggtggaagagctgagaagcaggagcagagggcagacaacagacacccagcgggctcagttctcctcagcacagggcctggttggccgtaatcgttcctcggcccgtactcgcccagactctggcagcccctgcttcccaggcagttcagacggatccagggagttgtgcagttgcctgtagacactgagtgtacagtcttccccttcttcctccatgcttgctgagtggttccaggctgcgacagtgatggtgtctcctacccgattccgacgggtaagcacctctgacacagtgaggctactttgggtccttctggaggagggctcaggggcatcccctgaacttggtcctacccttcgagtgccctgctcaaaaaggcaggacctgggctgttcgagttctgagaagtctgtggaagacctctgggtgtaggcattgctattggtagattccacgtttttacctattcgagttggggggtcttctaaagatttcaagtctcgcctactcttccaggcattccgcacagtaacatgtctggcatctgagaagcccacttctgaaggggcactatggcttttccacctgattgtctccgctggaggtgcatggctattcctctccacaggatccgatggcttgattataatgctgctccgagagaccactgtttctggcctgttcttcaggggcccatctgccattctctccgcttctgcaagctgcagggtgatgtcatgtttgtgaatggagagctcaaaaggggagctgacatggttgctaactgatgtgagctctgccagccccacctggatattgctagtggatgtgtgcctctccctcagggcctcacccggagcagctctggggctgctgctgtcagatggatatatagtaatgctacttgtcactttgtttggccctggtttggagacgggtttctgtttctccaacgtagtctctgttccagatcctcccatgatttttttcacatccttatcaacaataacaggtttgatgatggctctagaccgcaacgcctctctggggctaaagggcctttggctttttaccccagcaccattggtatctgggagctccatggtattggtggaggctctgacagatttcacagattcattctccattccagcatctttatcattctcaaatagggaggttctaggtgcccctcgggttttagccttttctctagagttaggctgtggtttgggctctggctctggagtgatggttgtatttaccaacttggcagtaacaagagatgctatgtccaagtcatcatctgagtctggcttctctctgccactggatttgatgactcgacacctcaaggcttcatgcggactgctgtcttccatcacaactgctgcaggttgattaaccccttctttatgtgaggttgaaaatccctgaaggatgttctcttggcttctacagctataaggatacttcgatagaacaggagccttggaattcgggcaactgttatcagcctcaaggccattggcagcctttttgcctttagagagcccttctgaggaggatcttcgagatgaggccagggctccaatggccttagaacagccagagtttgcagcctgagttacttgacttccgttgccaagcacgtgtcccctcttgccaaagacagtctcagaggaggtgtcagaagccttgtcagctctacccaatgggtcactgggaacagatccatgggtggtgtcactaaacgttcgtgttgtcttctccacttttcccttcagtccactctcggtgcctggcttggaagtccccttccacgctttactgtgctcctgagcagccggggggtagcgactcagcactgagggctgctccctagacttcttcccttcgctcttggaggagctgggtacaaaccggtcttcagttttctttgtctcctgagtcccactgtctgtactcacccccatgtgagaagcttttgctgccctcctgttggtgaaactgggagaagaaacctgcctgttgctcagagaatagttttcattgttgagagcaaactccctgttccggagtcgttcccgcttatgctgaggagacagttcccgcgctgtgtgcttggacacagaagcttcacttccgtggcctctaaacttagtcctctcatgtctgcctttgctggacaggaaagcatcttccccttctacctctccattttctaactctttctgtttcttgatttgtagctttatctcctccagttggctggctaataatttgtttttattttgttcacttaggtaattatcctgaaggtcgttatttttggacttcattttcttaagctcttcttccaacgattcaaagtgtttgatttgcgtcttaagtttctcaatctcttggttaaggtctttgactttgttgtcttcctgattgcggttcttttcattttctgatttgtttcttgtttcattctctacctgctttaggtagtccagaccacccttccttcttgattctttggacggcagtgtggaagagatgccatcctcaatccgtaggtcatttctttccagattagaagcattccttgtataatctcggttcatttttttgttctgctctagtttttgagtgagttcttttatcaatttctcattttctttctccttttcattcaagtattttctctcacttacaaagctcagagttaatgatttcagcttttctaactctgacgctaaactctgctcagttttatccaggcggtcctcagaagattctagttctttcactttgactctgagcatttccagctcagaggagattttcttggtcagatttctctcctcattcaggctcagacacagctgggtacagtcattcttactcctgctgaaggcctcttctagcttctctaattcagccattcgtttctgaagccgctcaatctcagatttcagctcccgggtgaggttttcttcctcttcaagtttctccttcatcagacgacacagatcctctgctctcttaatttcctcgtctttgccttcaattctcagcacccgctggcgcagcacttcaatctccgccaacatgctggagttgctaccttctgcctgaatcaccttgtcctggagatccaggagttcatcctctgctttctggaggttttttgtggcttcctccaactcatcaaggcggcggcttagactctgtagcttaaaccgcaagtggcggctggaggccgtctccttgtagcttgtaaattcggccatgtctactgccagccaatgtgggctcctagaggcatccaattccactcaaggggatgagaaatggttacctttctcttggcaaccacaatcttctttgacagctggagaccatcatcaatcatgtaggtaattcaagctttccgtcaatacttccagggattcaagaatgagaggggatactctagagcagactagcagcaatcacggtgcactgcc

SEQ ID NO: 736418 - DNA, 11856 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgagggtggcattagatgcttgccacttagtagcaagagccgccaagtaggaattgatgcttgcaagtgtttttggctgtggtatccacattttagccagaagcgcagatgtcctttgctttcttcgttaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacacccaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagcctcctcactgccaaatctgatacagacaagggcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgcagactgggaaacaggcccacggagcttctctgagctcatccccatgagattaaaacatacagaaactaaaaaacaaggcccagaaaaacaattgagggcaggagggaagaacccacacggatgataccttccacaagcaaaaatcatcccatactattatagatggtgaaaacaggagaaccttagaataccagatttggtgcccttagagatcatccatttcaaagaactcattttacagacagggaaactgaggctccaagaagacaatgactcacccaaggtcacacagcaaggaagtaaagccatggggaaaaaaatccagcttaccagactggtagtttaatgttctctcattctgagggcaatagtgtctacttcataaaggtagcctttgaaagaggatcccttctttgaattgacagaatgctaaagaaaaagcactgccaagaatatacaattcttttcaacttccccatgtgactggtataaggaacctaaccaatttatttacgtggctttctgaaaagtttgctgcattttgaactatataaagctgaggccctcaatgcgtatgtacgtatcacctttcctccagcgaagtcatcatgatagtcgacttgcagaaatccggggcccacttctgtaggaatgcatcagcttggtaaagtgcgatgcctcctccatgggggatggagaaggaggaacaggagggagtagtctcacagtccatgcctctcatggagctattgcttgtggagtgactaaaggggtctgctttccctcttgctgggcacttcctagaaggcagaggatgctgggtcaggcccagcttagcctagggattttcccaaggtggaaacaatgaagtcagcttgaagtctccagccactggagagaaagcaggcgatgccagcagcattactggtgctcaggaaaggagatgcatgaggcttgcacctccaggtgcctttggaaggtgagcagagagagctggggttggggagggatgatgtcattccaatgggtatccgcatgagtatctgcatgctctgcttccaggagactggtaagccaggagcaggtcaaacttcaacctaaagggtagtctcataatcctttagaggcagcacagacccctttctgctttaagtctgaagaaaagaactccaaggggaaagaaatgaaagccccctagatagagctgatggctggtaaatcttatggggtacttgagcccattgggcaaatgaggagtgaagtggatatagtgaggagactgagaaaccagaacattaaccacacagacagaggctgccctaggatccagaaacaacccaccaaggagccgagaagaatttttgactcctgctgtgtgctggggactttatcttcccttgtttgggggccagaatggtccaactacttggtggacagggacaaggagagagagaggactcgtgcattggggaaggttgggcctgggtgactgtccagcttgtagtctctgattccctctggccaaatggcaaaaattacctgagccacagcccggctctaccacagttttccagccaaggcttgtgtcttgcctggttaactggccttggatccttcgtggggcaggacggtggaagagctgagaagcaggagcagagggcagacaacagacacccagcgggctcagttctcctcagcacagggcctggttggccgtaatcgttcctcggcccgtactcgcccagactctggcagcccctgcttcccaggcagttcagacggatccagggagttgtgcagttgcctgtagacactgagtgtacagtcttccccttcttcctccatgcttgctgagtggttccaggctgcgacagtgatggtgtctcctacccgattccgacgggtaagcacctctgacacagtgaggctactttgggtccttctggaggagggctcaggggcatcccctgaacttggtcctacccttcgagtgccctgctcaaaaaggcaggacctgggctgttcgagttctgagaagtctgtggaagacctctgggtgtaggcattgctattggtagattccacgtttttacctattcgagttggggggtcttctaaagatttcaagtctcgcctactcttccaggcattccgcacagtaacatgtctggcatctgagaagcccacttctgaaggggcactatggcttttccacctgattgtctccgctggaggtgcatggctattcctctccacaggatccgatggcttgattataatgctgctccgagagaccactgtttctggcctgttcttcaggggcccatctgccattctctccgcttctgcaagctgcagggtgatgtcatgtttgtgaatggagagctcaaaaggggagctgacatggttgctaactgatgtgagctctgccagccccacctggatattgctagtggatgtgtgcctctccctcagggcctcacccggagcagctctggggctgctgctgtcagatggatatatagtaatgctacttgtcactttgtttggccctggtttggagacgggtttctgtttctccaacgtagtctctgttccagatcctcccatgatttttttcacatccttatcaacaataacaggtttgatgatggctctagaccgcaacgcctctctggggctaaagggcctttggctttttaccccagcaccattggtatctgggagctccatggtattggtggaggctctgacagatttcacagattcattctccattccagcatctttatcattctcaaatagggaggttctaggtgcccctcgggttttagccttttctctagagttaggctgtggtttgggctctggctctggagtgatggttgtatttaccaacttggcagtaacaagagatgctatgtccaagtcatcatctgagtctggcttctctctgccactggatttgatgactcgacacctcaaggcttcatgcggactgctgtcttccatcacaactgctgcaggttgattaaccccttctttatgtgaggttgaaaatccctgaaggatgttctcttggcttctacagctataaggatacttcgatagaacaggagccttggaattcgggcaactgttatcagcctcaaggccattggcagcctttttgcctttagagagcccttctgaggaggatcttcgagatgaggccagggctccaatggccttagaacagccagagtttgcagcctgagttacttgacttccgttgccaagcacgtgtcccctcttgccaaagacagtctcagaggaggtgtcagaagccttgtcagctctacccaatgggtcactgggaacagatccatgggtggtgtcactaaacgttcgtgttgtcttctccacttttcccttcagtccactctcggtgcctggcttggaagtccccttccacgctttactgtgctcctgagcagccggggggtagcgactcagcactgagggctgctccctagacttcttcccttcgctcttggaggagctgggtacaaaccggtcttcagttttctttgtctcctgagtcccactgtctgtactcacccccatgtgagaagcttttgctgccctcctgttggtgaaactgggagaagaaacctgcctgttgctcagagaatagttttcattgttgagagcaaactccctgttccggagtcgttcccgcttatgctgaggagacagttcccgcgctgtgtgcttggacacagaagcttcacttccgtggcctctaaacttagtcctctcatgtctgcctttgctggacaggaaagcatcttccccttctacctctccattttctaactctttctgtttcttgatttgtagctttatctcctccagttggctggctaataatttgtttttattttgttcacttaggtaattatcctgaaggtcgttatttttggacttcattttcttaagctcttcttccaacgattcaaagtgtttgatttgcgtcttaagtttctcaatctcttggttaaggtctttgactttgttgtcttcctgattgcggttcttttcattttctgatttgtttcttgtttcattctctacctgctttaggtagtccagaccacccttccttcttgattctttggacggcagtgtggaagagatgccatcctcaatccgtaggtcatttctttccagattagaagcattccttgtataatctcggttcatttttttgttctgctctagtttttgagtgagttcttttatcaatttctcattttctttctccttttcattcaagtattttctctcacttacaaagctcagagttaatgatttcagcttttctaactctgacgctaaactctgctcagttttatccaggcggtcctcagaagattctagttctttcactttgactctgagcatttccagctcagaggagattttcttggtcagatttctctcctcattcaggctcagacacagctgggtacagtcattcttactcctgctgaaggcctcttctagcttctctaattcagccattcgtttctgaagccgctcaatctcagatttcagctcccgggtgaggttttcttcctcttcaagtttctccttcatcagacgacacagatcctctgctctcttaatttcctcgtctttgccttcaattctcagcacccgctggcgcagcacttcaatctccgccaacatgctggagttgctaccttctgcctgaatcaccttgtcctggagatccaggagttcatcctctgctttctggaggttttttgtggcttcctccaactcatcaaggcggcggcttagactctgtagcttaaaccgcaagtggcggctggaggccgtctccttgtagcttgtaaattcggccatgtctactgccagccaatgtgggctcctagaggcatccaattccactcaaggggatgagaaatggttacctttctcttggcaaccacaatcttctttgacagctggagaccatcatcaatctctgcggccccgaaccgcgctcccgccagcgaagggttccgccgctcagctgccagcgaccctcgtgcc

SEQ ID NO: 736419 - DNA, 11867 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgagggtggcattagatgcttgccacttagtagcaagagccgccaagtaggaattgatgcttgcaagtgtttttggctgtggtatccacattttagccagaagcgcagatgtcctttgctttcttcgttaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacacccaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagcctcctcactgccaaatctgatacagacaagggcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgcagactgggaaacaggcccacggagcttctctgagctcatccccatgagattaaaacatacagaaactaaaaaacaaggcccagaaaaacaattgagggcaggagggaagaacccacacggatgataccttccacaagcaaaaatcatcccatactattatagatggtgaaaacaggagaaccttagaataccagatttggtgcccttagagatcatccatttcaaagaactcattttacagacagggaaactgaggctccaagaagacaatgactcacccaaggtcacacagcaaggaagtaaagccatggggaaaaaaatccagcttaccagactggtagtttaatgttctctcattctgagggcaatagtgtctacttcataaaggtagcctttgaaagaggatcccttctttgaattgacagaatgctaaagaaaaagcactgccaagaatatacaattcttttcaacttccccatgtgactggtataaggaacctaaccaatttatttacgtggctttctgaaaagtttgctgcattttgaactatataaagctgaggccctcaatgcgtatgtacgtatcacctttcctccagcgaagtcatcatgatagtcgacttgcagaaatccggggcccacttctgtaggaatgcatcagcttggtaaagtgcgatgcctcctccatgggggatggagaaggaggaacaggagggagtagtctcacagtccatgcctctcatggagctattgcttgtggagtgactaaaggggtctgctttccctcttgctgggcacttcctagaaggcagaggatgctgggtcaggcccagcttagcctagggattttcccaaggtggaaacaatgaagtcagcttgaagtctccagccactggagagaaagcaggcgatgccagcagcattactggtgctcaggaaaggagatgcatgaggcttgcacctccaggtgcctttggaaggtgagcagagagagctggggttggggagggatgatgtcattccaatgggtatccgcatgagtatctgcatgctctgcttccaggagactggtaagccaggagcaggtcaaacttcaacctaaagggtagtctcataatcctttagaggcagcacagacccctttctgctttaagtctgaagaaaagaactccaaggggaaagaaatgaaagccccctagatagagctgatggctggtaaatcttatggggtacttgagcccattgggcaaatgaggagtgaagtggatatagtgaggagactgagaaaccagaacattaaccacacagacagaggctgccctaggatccagaaacaacccaccaaggagccgagaagaatttttgactcctgctgtgtgctggggactttatcttcccttgtttgggggccagaatggtccaactacttggtggacagggacaaggagagagagaggactcgtgcattggggaaggttgggcctgggtgactgtccagcttgtagtctctgattccctctggccaaatggcaaaaattacctgagccacagcccggctctaccacagttttccagccaaggcttgtgtcttgcctggttaactggccttggatccttcgtggggcaggacggtggaagagctgagaagcaggagcagagggcagacaacagacacccagcgggctcagttctcctcagcacagggcctggttggccgtaatcgttcctcggcccgtactcgcccagactctggcagcccctgcttcccaggcagttcagacggatccagggagttgtgcagttgcctgtagacactgagtgtacagtcttccccttcttcctccatgcttgctgagtggttccaggctgcgacagtgatggtgtctcctacccgattccgacgggtaagcacctctgacacagtgaggctactttgggtccttctggaggagggctcaggggcatcccctgaacttggtcctacccttcgagtgccctgctcaaaaaggcaggacctgggctgttcgagttctgagaagtctgtggaagacctctgggtgtaggcattgctattggtagattccacgtttttacctattcgagttggggggtcttctaaagatttcaagtctcgcctactcttccaggcattccgcacagtaacatgtctggcatctgagaagcccacttctgaaggggcactatggcttttccacctgattgtctccgctggaggtgcatggctattcctctccacaggatccgatggcttgattataatgctgctccgagagaccactgtttctggcctgttcttcaggggcccatctgccattctctccgcttctgcaagctgcagggtgatgtcatgtttgtgaatggagagctcaaaaggggagctgacatggttgctaactgatgtgagctctgccagccccacctggatattgctagtggatgtgtgcctctccctcagggcctcacccggagcagctctggggctgctgctgtcagatggatatatagtaatgctacttgtcactttgtttggccctggtttggagacgggtttctgtttctccaacgtagtctctgttccagatcctcccatgatttttttcacatccttatcaacaataacaggtttgatgatggctctagaccgcaacgcctctctggggctaaagggcctttggctttttaccccagcaccattggtatctgggagctccatggtattggtggaggctctgacagatttcacagattcattctccattccagcatctttatcattctcaaatagggaggttctaggtgcccctcgggttttagccttttctctagagttaggctgtggtttgggctctggctctggagtgatggttgtatttaccaacttggcagtaacaagagatgctatgtccaagtcatcatctgagtctggcttctctctgccactggatttgatgactcgacacctcaaggcttcatgcggactgctgtcttccatcacaactgctgcaggttgattaaccccttctttatgtgaggttgaaaatccctgaaggatgttctcttggcttctacagctataaggatacttcgatagaacaggagccttggaattcgggcaactgttatcagcctcaaggccattggcagcctttttgcctttagagagcccttctgaggaggatcttcgagatgaggccagggctccaatggccttagaacagccagagtttgcagcctgagttacttgacttccgttgccaagcacgtgtcccctcttgccaaagacagtctcagaggaggtgtcagaagccttgtcagctctacccaatgggtcactgggaacagatccatgggtggtgtcactaaacgttcgtgttgtcttctccacttttcccttcagtccactctcggtgcctggcttggaagtccccttccacgctttactgtgctcctgagcagccggggggtagcgactcagcactgagggctgctccctagacttcttcccttcgctcttggaggagctgggtacaaaccggtcttcagttttctttgtctcctgagtcccactgtctgtactcacccccatgtgagaagcttttgctgccctcctgttggtgaaactgggagaagaaacctgcctgttgctcagagaatagttttcattgttgagagcaaactccctgttccggagtcgttcccgcttatgctgaggagacagttcccgcgctgtgtgcttggacacagaagcttcacttccgtggcctctaaacttagtcctctcatgtctgcctttgctggacaggaaagcatcttccccttctacctctccattttctaactctttctgtttcttgatttgtagctttatctcctccagttggctggctaataatttgtttttattttgttcacttaggtaattatcctgaaggtcgttatttttggacttcattttcttaagctcttcttccaacgattcaaagtgtttgatttgcgtcttaagtttctcaatctcttggttaaggtctttgactttgttgtcttcctgattgcggttcttttcattttctgatttgtttcttgtttcattctctacctgctttaggtagtccagaccacccttccttcttgattctttggacggcagtgtggaagagatgccatcctcaatccgtaggtcatttctttccagattagaagcattccttgtataatctcggttcatttttttgttctgctctagtttttgagtgagttcttttatcaatttctcattttctttctccttttcattcaagtattttctctcacttacaaagctcagagttaatgatttcagcttttctaactctgacgctaaactctgctcagttttatccaggcggtcctcagaagattctagttctttcactttgactctgagcatttccagctcagaggagattttcttggtcagatttctctcctcattcaggctcagacacagctgggtacagtcattcttactcctgctgaaggcctcttctagcttctctaattcagccattcgtttctgaagccgctcaatctcagatttcagctcccgggtgaggttttcttcctcttcaagtttctccttcatcagacgacacagatcctctgctctcttaatttcctcgtctttgccttcaattctcagcacccgctggcgcagcacttcaatctccgccaacatgctggagttgctaccttctgcctgaatcaccttgtcctggagatccaggagttcatcctctgctttctggaggttttttgtggcttcctccaactcatcaaggcggcggcttagactctgtagcttaaaccgcaagtggcggctggaggccgtctccttgtagcttgtaaattcggccatgtctactgccagccaatgtgggctcctagaggcatccaattccactcaaggggatgagaaatggttacctttctcttggcaaccacaatcttctttgacagctggagaccatcatcaatattgcagcacctttactccttcggctgtgatccaatctccagctcactttttgccagcaccaacattggcctactatgggc

SEQ ID NO: 736420 - DNA, 5398 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgagggtggcattagatgcttgccacttagtagcaagagccgccaagtaggaattgatgcttgcaagtgtttttggctgtggtatccacattttagccagaagcgcagatgtcctttgctttcttcgttaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctccctcgtgccgaattcgccaccagg

SEQ ID NO: 736421 - DNA, 4733 bp, Homo sapiens
  misc_feature (4710)..(4710): n is a, c, g, or t
  misc_feature (4714)..(4714): n is a, c, g, or t
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgagggtggcattagatgcttgccacttagtagcaagagccgccaagtaggaattgatgcttgcaagtgtttttggctgtggtatccacattttagccagaagcgcagatgtcctttgctttcttcgttaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggttcccccaaaaatttgggagcccctatttggtngggnaaaggatcctttgggggcc

SEQ ID NO: 736422 - DNA, 4268 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgagggtggcattagatgcttgccacttagtagcaagagccgccaagtaggaattgatgcttgcaagtgtttttggctgtggtatccacattttagccagaagcgcagatgtcctttgctttcttcgttaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggcccgcgtacctgcccgggcggccgctcgaa

SEQ ID NO: 736423 - DNA, 3721 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgagggtggcattagatgcttgccacttagtagcaagagccgccaagtaggaattgatgcttgcaagtgtttttggctgtggtatccacattttagccagaagcgcagatgtcctttgctttcttcgttaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattgcccccaaattttgcttttttttgccaaattccccttttgggggggctttaaaaatctaaggggccggttttaataaacttgcgtcgggaaaaaacctggggttccaccaataaaccccttttgaaaaaatctcctttttccgagggggcattaatctggaaaagctcctccatatgtccctttcaaaaagtttgatcccctatatggctaacgaaatatgttccggttaatttttttaaaaatcggtgaaaattttttcaaaaacgcctttttttttatacacaatagtgcccaattctggactctttttttattcatatccccccggttgggg

SEQ ID NO: 736424 - DNA, 1295 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaagtaaggacctcctacctggctgataaattttacatttttaagttacggtttcaggactgtattttatatctatgatgacgttaggattttattttgattcataagactatatttaaaaatatttccaagtttatcttcttaaagtcaagttaaatataataaataaataataaaaaatatagtctcttaataaatgtgcatttcccttaatttctagtttgatagctacttagtaaaagatactggatttccaattt

SEQ ID NO: 736425 - DNA, 11896 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacacccaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagcctcctcactgccaaatctgatacagacaagggcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgcagactgggaaacaggcccacggagcttctctgagctcatccccatgagattaaaacatacagaaactaaaaaacaaggcccagaaaaacaattgagggcaggagggaagaacccacacggatgataccttccacaagcaaaaatcatcccatactattatagatggtgaaaacaggagaaccttagaataccagatttggtgcccttagagatcatccatttcaaagaactcattttacagacagggaaactgaggctccaagaagacaatgactcacccaaggtcacacagcaaggaagtaaagccatggggaaaaaaatccagcttaccagactggtagtttaatgttctctcattctgagggcaatagtgtctacttcataaaggtagcctttgaaagaggatcccttctttgaattgacagaatgctaaagaaaaagcactgccaagaatatacaattcttttcaacttccccatgtgactggtataaggaacctaaccaatttatttacgtggctttctgaaaagtttgctgcattttgaactatataaagctgaggccctcaatgcgtatgtacgtatcacctttcctccagcgaagtcatcatgatagtcgacttgcagaaatccggggcccacttctgtaggaatgcatcagcttggtaaagtgcgatgcctcctccatgggggatggagaaggaggaacaggagggagtagtctcacagtccatgcctctcatggagctattgcttgtggagtgactaaaggggtctgctttccctcttgctgggcacttcctagaaggcagaggatgctgggtcaggcccagcttagcctagggattttcccaaggtggaaacaatgaagtcagcttgaagtctccagccactggagagaaagcaggcgatgccagcagcattactggtgctcaggaaaggagatgcatgaggcttgcacctccaggtgcctttggaaggtgagcagagagagctggggttggggagggatgatgtcattccaatgggtatccgcatgagtatctgcatgctctgcttccaggagactggtaagccaggagcaggtcaaacttcaacctaaagggtagtctcataatcctttagaggcagcacagacccctttctgctttaagtctgaagaaaagaactccaaggggaaagaaatgaaagccccctagatagagctgatggctggtaaatcttatggggtacttgagcccattgggcaaatgaggagtgaagtggatatagtgaggagactgagaaaccagaacattaaccacacagacagaggctgccctaggatccagaaacaacccaccaaggagccgagaagaatttttgactcctgctgtgtgctggggactttatcttcccttgtttgggggccagaatggtccaactacttggtggacagggacaaggagagagagaggactcgtgcattggggaaggttgggcctgggtgactgtccagcttgtagtctctgattccctctggccaaatggcaaaaattacctgagccacagcccggctctaccacagttttccagccaaggcttgtgtcttgcctggttaactggccttggatccttcgtggggcaggacggtggaagagctgagaagcaggagcagagggcagacaacagacacccagcgggctcagttctcctcagcacagggcctggttggccgtaatcgttcctcggcccgtactcgcccagactctggcagcccctgcttcccaggcagttcagacggatccagggagttgtgcagttgcctgtagacactgagtgtacagtcttccccttcttcctccatgcttgctgagtggttccaggctgcgacagtgatggtgtctcctacccgattccgacgggtaagcacctctgacacagtgaggctactttgggtccttctggaggagggctcaggggcatcccctgaacttggtcctacccttcgagtgccctgctcaaaaaggcaggacctgggctgttcgagttctgagaagtctgtggaagacctctgggtgtaggcattgctattggtagattccacgtttttacctattcgagttggggggtcttctaaagatttcaagtctcgcctactcttccaggcattccgcacagtaacatgtctggcatctgagaagcccacttctgaaggggcactatggcttttccacctgattgtctccgctggaggtgcatggctattcctctccacaggatccgatggcttgattataatgctgctccgagagaccactgtttctggcctgttcttcaggggcccatctgccattctctccgcttctgcaagctgcagggtgatgtcatgtttgtgaatggagagctcaaaaggggagctgacatggttgctaactgatgtgagctctgccagccccacctggatattgctagtggatgtgtgcctctccctcagggcctcacccggagcagctctggggctgctgctgtcagatggatatatagtaatgctacttgtcactttgtttggccctggtttggagacgggtttctgtttctccaacgtagtctctgttccagatcctcccatgatttttttcacatccttatcaacaataacaggtttgatgatggctctagaccgcaacgcctctctggggctaaagggcctttggctttttaccccagcaccattggtatctgggagctccatggtattggtggaggctctgacagatttcacagattcattctccattccagcatctttatcattctcaaatagggaggttctaggtgcccctcgggttttagccttttctctagagttaggctgtggtttgggctctggctctggagtgatggttgtatttaccaacttggcagtaacaagagatgctatgtccaagtcatcatctgagtctggcttctctctgccactggatttgatgactcgacacctcaaggcttcatgcggactgctgtcttccatcacaactgctgcaggttgattaaccccttctttatgtgaggttgaaaatccctgaaggatgttctcttggcttctacagctataaggatacttcgatagaacaggagccttggaattcgggcaactgttatcagcctcaaggccattggcagcctttttgcctttagagagcccttctgaggaggatcttcgagatgaggccagggctccaatggccttagaacagccagagtttgcagcctgagttacttgacttccgttgccaagcacgtgtcccctcttgccaaagacagtctcagaggaggtgtcagaagccttgtcagctctacccaatgggtcactgggaacagatccatgggtggtgtcactaaacgttcgtgttgtcttctccacttttcccttcagtccactctcggtgcctggcttggaagtccccttccacgctttactgtgctcctgagcagccggggggtagcgactcagcactgagggctgctccctagacttcttcccttcgctcttggaggagctgggtacaaaccggtcttcagttttctttgtctcctgagtcccactgtctgtactcacccccatgtgagaagcttttgctgccctcctgttggtgaaactgggagaagaaacctgcctgttgctcagagaatagttttcattgttgagagcaaactccctgttccggagtcgttcccgcttatgctgaggagacagttcccgcgctgtgtgcttggacacagaagcttcacttccgtggcctctaaacttagtcctctcatgtctgcctttgctggacaggaaagcatcttccccttctacctctccattttctaactctttctgtttcttgatttgtagctttatctcctccagttggctggctaataatttgtttttattttgttcacttaggtaattatcctgaaggtcgttatttttggacttcattttcttaagctcttcttccaacgattcaaagtgtttgatttgcgtcttaagtttctcaatctcttggttaaggtctttgactttgttgtcttcctgattgcggttcttttcattttctgatttgtttcttgtttcattctctacctgctttaggtagtccagaccacccttccttcttgattctttggacggcagtgtggaagagatgccatcctcaatccgtaggtcatttctttccagattagaagcattccttgtataatctcggttcatttttttgttctgctctagtttttgagtgagttcttttatcaatttctcattttctttctccttttcattcaagtattttctctcacttacaaagctcagagttaatgatttcagcttttctaactctgacgctaaactctgctcagttttatccaggcggtcctcagaagattctagttctttcactttgactctgagcatttccagctcagaggagattttcttggtcagatttctctcctcattcaggctcagacacagctgggtacagtcattcttactcctgctgaaggcctcttctagcttctctaattcagccattcgtttctgaagccgctcaatctcagatttcagctcccgggtgaggttttcttcctcttcaagtttctccttcatcagacgacacagatcctctgctctcttaatttcctcgtctttgccttcaattctcagcacccgctggcgcagcacttcaatctccgccaacatgctggagttgctaccttctgcctgaatcaccttgtcctggagatccaggagttcatcctctgctttctggaggttttttgtggcttcctccaactcatcaaggcggcggcttagactctgtagcttaaaccgcaagtggcggctggaggccgtctccttgtagcttgtaaattcggccatgtctactgccagccaatgtgggctcctagaggcatccaattccactcaaggggatgagaaatggttacctttctcttggcaaccacaatcttctttgacagctggagaccatcatcaatcatgtaggtaattcaagctttccgtcaatacttccggcggctctccctatgcttgctgttttggaaacagtcactcactctctttcaaaggcagttgtctcttgacctgatctcatctgataggtcgcagtcaaaatacaggcacacaatactcaggtttattcaatgtcccctctgcggccccgaaccgcgctcccgccagcgaagggttccgccgctcagctgccagcgaccctcgtgcc

SEQ ID NO: 736426 - DNA, 2461 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacacttggatcccagaacacccgatcaaaacacaacaccaccttgtaaggttgccaaatcccatcctttggactgcagatgtttggta

SEQ ID NO: 736427 - DNA, 2252 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaagggtgtggtttgacggtgcttggaccaggcattgtcgctgtgcagacatgcacag

SEQ ID NO: 736428 - DNA, 2367 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtgggctgcgctttgaaccgggtgttacaggatcccaggtcacattgtcccggcattttgcaaacaactgcccagggtgagaacttcctcctcgtgaacctttaaggccacactgtggcactgggaaacccggctcgtgacacaacctcgtatagtgcagacggcccaa

SEQ ID NO: 736429 - DNA, 2048 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcgggtattcacagctatcacttcacatcctgaccccgtgtagcgaacctgtcgcactgctggtcgacc

SEQ ID NO: 736430 - DNA, 2251 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgtcataggttcgcaggggccacttgaaggacaaggaaggttggttgaaggtagttgtgtccctgccccttcttcatccatcaactgcccttccccaggctgcctataattcatccattagagaaggaaaaatcaatatttaccaacataaattaaaacccaggcagggaacaggcagagtataggcagggcctgggagcagagagtggctccgtgggcagccaggtggtagcccatgcacattgggacccggggatgctcaggtgacagaatggagcaggtgggccttctggtccagcggcctctgagaccccaccagagcaagcctgtctcctctcctgcagcgtcctccgtagagagcacggagaccccctcatcgaggagctcatcccggcgacgcttggacctgagggcggggccagttagggc

SEQ ID NO: 736431 - DNA, 11914 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtcctttgttcttttgcagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacacccaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagcctcctcactgccaaatctgatacagacaagggcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgcagactgggaaacaggcccacggagcttctctgagctcatccccatgagattaaaacatacagaaactaaaaaacaaggcccagaaaaacaattgagggcaggagggaagaacccacacggatgataccttccacaagcaaaaatcatcccatactattatagatggtgaaaacaggagaaccttagaataccagatttggtgcccttagagatcatccatttcaaagaactcattttacagacagggaaactgaggctccaagaagacaatgactcacccaaggtcacacagcaaggaagtaaagccatggggaaaaaaatccagcttaccagactggtagtttaatgttctctcattctgagggcaatagtgtctacttcataaaggtagcctttgaaagaggatcccttctttgaattgacagaatgctaaagaaaaagcactgccaagaatatacaattcttttcaacttccccatgtgactggtataaggaacctaaccaatttatttacgtggctttctgaaaagtttgctgcattttgaactatataaagctgaggccctcaatgcgtatgtacgtatcacctttcctccagcgaagtcatcatgatagtcgacttgcagaaatccggggcccacttctgtaggaatgcatcagcttggtaaagtgcgatgcctcctccatgggggatggagaaggaggaacaggagggagtagtctcacagtccatgcctctcatggagctattgcttgtggagtgactaaaggggtctgctttccctcttgctgggcacttcctagaaggcagaggatgctgggtcaggcccagcttagcctagggattttcccaaggtggaaacaatgaagtcagcttgaagtctccagccactggagagaaagcaggcgatgccagcagcattactggtgctcaggaaaggagatgcatgaggcttgcacctccaggtgcctttggaaggtgagcagagagagctggggttggggagggatgatgtcattccaatgggtatccgcatgagtatctgcatgctctgcttccaggagactggtaagccaggagcaggtcaaacttcaacctaaagggtagtctcataatcctttagaggcagcacagacccctttctgctttaagtctgaagaaaagaactccaaggggaaagaaatgaaagccccctagatagagctgatggctggtaaatcttatggggtacttgagcccattgggcaaatgaggagtgaagtggatatagtgaggagactgagaaaccagaacattaaccacacagacagaggctgccctaggatccagaaacaacccaccaaggagccgagaagaatttttgactcctgctgtgtgctggggactttatcttcccttgtttgggggccagaatggtccaactacttggtggacagggacaaggagagagagaggactcgtgcattggggaaggttgggcctgggtgactgtccagcttgtagtctctgattccctctggccaaatggcaaaaattacctgagccacagcccggctctaccacagttttccagccaaggcttgtgtcttgcctggttaactggccttggatccttcgtggggcaggacggtggaagagctgagaagcaggagcagagggcagacaacagacacccagcgggctcagttctcctcagcacagggcctggttggccgtaatcgttcctcggcccgtactcgcccagactctggcagcccctgcttcccaggcagttcagacggatccagggagttgtgcagttgcctgtagacactgagtgtacagtcttccccttcttcctccatgcttgctgagtggttccaggctgcgacagtgatggtgtctcctacccgattccgacgggtaagcacctctgacacagtgaggctactttgggtccttctggaggagggctcaggggcatcccctgaacttggtcctacccttcgagtgccctgctcaaaaaggcaggacctgggctgttcgagttctgagaagtctgtggaagacctctgggtgtaggcattgctattggtagattccacgtttttacctattcgagttggggggtcttctaaagatttcaagtctcgcctactcttccaggcattccgcacagtaacatgtctggcatctgagaagcccacttctgaaggggcactatggcttttccacctgattgtctccgctggaggtgcatggctattcctctccacaggatccgatggcttgattataatgctgctccgagagaccactgtttctggcctgttcttcaggggcccatctgccattctctccgcttctgcaagctgcagggtgatgtcatgtttgtgaatggagagctcaaaaggggagctgacatggttgctaactgatgtgagctctgccagccccacctggatattgctagtggatgtgtgcctctccctcagggcctcacccggagcagctctggggctgctgctgtcagatggatatatagtaatgctacttgtcactttgtttggccctggtttggagacgggtttctgtttctccaacgtagtctctgttccagatcctcccatgatttttttcacatccttatcaacaataacaggtttgatgatggctctagaccgcaacgcctctctggggctaaagggcctttggctttttaccccagcaccattggtatctgggagctccatggtattggtggaggctctgacagatttcacagattcattctccattccagcatctttatcattctcaaatagggaggttctaggtgcccctcgggttttagccttttctctagagttaggctgtggtttgggctctggctctggagtgatggttgtatttaccaacttggcagtaacaagagatgctatgtccaagtcatcatctgagtctggcttctctctgccactggatttgatgactcgacacctcaaggcttcatgcggactgctgtcttccatcacaactgctgcaggttgattaaccccttctttatgtgaggttgaaaatccctgaaggatgttctcttggcttctacagctataaggatacttcgatagaacaggagccttggaattcgggcaactgttatcagcctcaaggccattggcagcctttttgcctttagagagcccttctgaggaggatcttcgagatgaggccagggctccaatggccttagaacagccagagtttgcagcctgagttacttgacttccgttgccaagcacgtgtcccctcttgccaaagacagtctcagaggaggtgtcagaagccttgtcagctctacccaatgggtcactgggaacagatccatgggtggtgtcactaaacgttcgtgttgtcttctccacttttcccttcagtccactctcggtgcctggcttggaagtccccttccacgctttactgtgctcctgagcagccggggggtagcgactcagcactgagggctgctccctagacttcttcccttcgctcttggaggagctgggtacaaaccggtcttcagttttctttgtctcctgagtcccactgtctgtactcacccccatgtgagaagcttttgctgccctcctgttggtgaaactgggagaagaaacctgcctgttgctcagagaatagttttcattgttgagagcaaactccctgttccggagtcgttcccgcttatgctgaggagacagttcccgcgctgtgtgcttggacacagaagcttcacttccgtggcctctaaacttagtcctctcatgtctgcctttgctggacaggaaagcatcttccccttctacctctccattttctaactctttctgtttcttgatttgtagctttatctcctccagttggctggctaataatttgtttttattttgttcacttaggtaattatcctgaaggtcgttatttttggacttcattttcttaagctcttcttccaacgattcaaagtgtttgatttgcgtcttaagtttctcaatctcttggttaaggtctttgactttgttgtcttcctgattgcggttcttttcattttctgatttgtttcttgtttcattctctacctgctttaggtagtccagaccacccttccttcttgattctttggacggcagtgtggaagagatgccatcctcaatccgtaggtcatttctttccagattagaagcattccttgtataatctcggttcatttttttgttctgctctagtttttgagtgagttcttttatcaatttctcattttctttctccttttcattcaagtattttctctcacttacaaagctcagagttaatgatttcagcttttctaactctgacgctaaactctgctcagttttatccaggcggtcctcagaagattctagttctttcactttgactctgagcatttccagctcagaggagattttcttggtcagatttctctcctcattcaggctcagacacagctgggtacagtcattcttactcctgctgaaggcctcttctagcttctctaattcagccattcgtttctgaagccgctcaatctcagatttcagctcccgggtgaggttttcttcctcttcaagtttctccttcatcagacgacacagatcctctgctctcttaatttcctcgtctttgccttcaattctcagcacccgctggcgcagcacttcaatctccgccaacatgctggagttgctaccttctgcctgaatcaccttgtcctggagatccaggagttcatcctctgctttctggaggttttttgtggcttcctccaactcatcaaggcggcggcttagactctgtagcttaaaccgcaagtggcggctggaggccgtctccttgtagcttgtaaattcggccatgtctactgccagccaatgtgggctcctagaggcatccaattccactcaaggggatgagaaatggttacctttctcttggcaaccacaatcttctttgacagctggagaccatcatcaatcatgtaggtaattcaagctttccgtcaatacttccggcggctctccctatgcttgctgttttggaaacagtcactcactctctttcaaaggcagttgtctcttgacctgatctcatctgataggtcgcagtcaaaatacaggcacacaatactcaggtttattcaatgtcccctctgcggccccgaaccgcgctcccgccagcgaagggttccgccgctcagctgccagcgaccctcgtgcc

SEQ ID NO: 736432 - DNA, 1631 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaccccccgagtgaagttcgggcaaagatt

SEQ ID NO: 736433 - DNA, 2066 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggtatgtcactgctttacaaaaggtaagagagaactctcctgaaacaggactgatcttttgttaggtgcgacctatcaggtacatttcctgatagagtgtttatgacaccataggta

SEQ ID NO: 736434 - DNA, 2500 bp, Homo sapiens
  misc_feature (1116)..(1116): n is a, c, g, or t
agtctaagcaaaccccagcaggaaagcaggggtacagagaggagcccccttggcaccgccaccgcaccctaggccacccaccatggcgctgggcttggagcaggcggaggagcagcggttgtaccagcagacgctcctgcaagacgggctcaaagacatgctggaccatggcaagttcctcgactgtgtggtgcgggcgggcgagcgcgagttcccgtgccatcgcctggtgctggccgcctgcagcccctacttccgggcgcgctttctagccgagccggagcgcgcgggcgagctgcacctggaggaggtgtccccggacgtggtggcccaggtgctgcactacctgtacacatcagagatcgcgctggatgaggcgagcgtgcaggatttgttcgccgcggcacaccgcttccagatcccttccatcttcaccatctgcgtgtccttcctgcagaagcgcctgtgcctctccaactgcttggccgtcttccgtctcggcctcctgctcgactgcgcgcgtctcgccgtggctgcccgcgacttcatctgcgctcacttcacgctggtggcgcgcgacgctgacttcctcggactctcggccgacgagctcatcgccatcatctccagcgacggccttaacgtggagaaggaggaggcagtgttcgaggcggtgatgcggtgggcgggtagcggcgacgccgaggcgcaggctgagcgccagcgcgcgctgcccaccgtcttcgagagcgtgcgctgccgcttgctgccgcgcgcctttctggaaagccgcgtggagcgccaccctctcgtgcgtgcccagcccgagttgctgcgcaaggtgcagatggtgaaggatgcacacgagggccgcatcaccacgctgcggaagaaaaagaaggggaaggatggagccggggccaaggaggctgataagggcacaagcaaagccaaagcagaggaggatgaggaggccgaacgtatccttcctgggatcctcaatgacaccctgcgcttcggcatgttcctgcaggatctcatcttcatgatcagtgaggagggcgctgtggcctacgatccagcagccaacgagtgctactgtgcttccctctccanccaggtccccaagaaccacgtcagcctggttaccaaggagaaccaggtcttcgtggctggaggcctcttctacaacgaagacaacaaagaggaccccatgagcgcatacttcctgcagtttgaccatctggactcagagtggctggggatgccaccgctgccctcgccccgctgcctctttggcctgggagaagctctcaactccatctacgtggtcggtggcagagagatcaaggacggcgagcgctgcctggactcggtcatgtgctacgacaggctgtcattcaaatggggtgaatcggacccgctgccttacgtggtgtatggccacacagtgctctcccacatggaccttgtctacgtaattggcggcaaaggcagtgacaggaagtgcctgaacaagatgtgcgtctatgaccccaagaagtttgagtggaaggagctggcacccatgcagaccgcccgctcactctttggggccactgtccatgatggccgcattatcgtggcagctggggtcaccgacacagggctgaccagttctgccgaagtgtacagcatcacagacaacaagtgggcacccttcgaggccttcccacaggagcgtagctcactcagcctggtcagcctggtgggtaccctctatgccattggtggctttgccacactggagacggagtctggagagctggttcccacagagctcaatgacatctggaggtataacgaggaggagaagaaatgggagggtgtcctgcgggagatcgcctatgcagcaggtgccaccttcctaccagtgcggctcaatgtgctgcgcctgactaagatgtgaccagctcaggcagactgaactaagcacccctcccatcctgcgaccctcactggcctggccttgtgggggctccagaaaagaggctaggagaggccagagtctacctggatccagttatggtgcctcaggggctgcgtcagccaaggaaagggaagtgctgcttagtcctggacttttgggccagggtgagaaactagaggcttctccagtgttgccatatccccctaggttgtcttgatccatgaaccagaaccacagggcggtatcccaggccgtgtgctggccctgccccagcctagctgagtgtgctggcaaagttccccacaggactcagccttctcgtctgtccgatgggagcatccccatcaagtgcagtgtacagtgcagatatgtctccttctttaggaagaataaagtgccttctgagcaagcagctcagggtctgcatcagtgctccaagagtcagtgagcaggtgtgttgaagacttggggcttcagtgttctgctgttgggctgccaaggtcgatggtctctgctctccatctggtgtcc

SEQ ID NO: 736435 - DNA, 2267 bp, Homo sapiens
  misc_feature (1116)..(1116): n is a, c, g, or t
agtctaagcaaaccccagcaggaaagcaggggtacagagaggagcccccttggcaccgccaccgcaccctaggccacccaccatggcgctgggcttggagcaggcggaggagcagcggttgtaccagcagacgctcctgcaagacgggctcaaagacatgctggaccatggcaagttcctcgactgtgtggtgcgggcgggcgagcgcgagttcccgtgccatcgcctggtgctggccgcctgcagcccctacttccgggcgcgctttctagccgagccggagcgcgcgggcgagctgcacctggaggaggtgtccccggacgtggtggcccaggtgctgcactacctgtacacatcagagatcgcgctggatgaggcgagcgtgcaggatttgttcgccgcggcacaccgcttccagatcccttccatcttcaccatctgcgtgtccttcctgcagaagcgcctgtgcctctccaactgcttggccgtcttccgtctcggcctcctgctcgactgcgcgcgtctcgccgtggctgcccgcgacttcatctgcgctcacttcacgctggtggcgcgcgacgctgacttcctcggactctcggccgacgagctcatcgccatcatctccagcgacggccttaacgtggagaaggaggaggcagtgttcgaggcggtgatgcggtgggcgggtagcggcgacgccgaggcgcaggctgagcgccagcgcgcgctgcccaccgtcttcgagagcgtgcgctgccgcttgctgccgcgcgcctttctggaaagccgcgtggagcgccaccctctcgtgcgtgcccagcccgagttgctgcgcaaggtgcagatggtgaaggatgcacacgagggccgcatcaccacgctgcggaagaaaaagaaggggaaggatggagccggggccaaggaggctgataagggcacaagcaaagccaaagcagaggaggatgaggaggccgaacgtatccttcctgggatcctcaatgacaccctgcgcttcggcatgttcctgcaggatctcatcttcatgatcagtgaggagggcgctgtggcctacgatccagcagccaacgagtgctactgtgcttccctctccanccaggtccccaagaaccacgtcagcctggttaccaaggagaaccaggtcttcgtggctggaggcctcttctacaacgaagacaacaaagaggaccccatgagcgcatacttcctgcagtttgaccatctggactcagagtggctggggatgccaccgctgccctcgccccgctgcctctttggcctgggagaagctctcaactccatctacgtggtcggtggcagagagatcaaggacggcgagcgctgcctggactcggtcatgtgctacgacaggctctggggtcaccgacacagggctgaccagttctgccgaagtgtacagcatcacagacaacaagtgggcacccttcgaggccttcccacaggagcgtagctcactcagcctggtcagcctggtgggtaccctctatgccattggtggctttgccacactggagacggagtctggagagctggttcccacagagctcaatgacatctggaggtataacgaggaggagaagaaatgggagggtgtcctgcgggagatcgcctatgcagcaggtgccaccttcctaccagtgcggctcaatgtgctgcgcctgactaagatgtgaccagctcaggcagactgaactaagcacccctcccatcctgcgaccctcactggcctggccttgtgggggctccagaaaagaggctaggagaggccagagtctacctggatccagttatggtgcctcaggggctgcgtcagccaaggaaagggaagtgctgcttagtcctggacttttgggccagggtgagaaactagaggcttctccagtgttgccatatccccctaggttgtcttgatccatgaaccagaaccacagggcggtatcccaggccgtgtgctggccctgccccagcctagctgagtgtgctggcaaagttccccacaggactcagccttctcgtctgtccgatgggagcatccccatcaagtgcagtgtacagtgcagatatgtctccttctttaggaagaataaagtgccttctgagcaagcagctcagggtctgcatcagtgctccaagagtcagtgagcaggtgtgttgaagacttggggcttcagtgttctgctgttgggctgccaaggtcgatggtctctgctctccatctggtgtcc

SEQ ID NO: 736436 - DNA, 633 bp, Homo sapiens
agcgggctggtacgtcatcaccaaagccaatctgctctagctgcccacagatgccaccaaaacctgctatctcttcatcaccaggatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatatcccgggaattc

SEQ ID NO: 736437 - DNA, 1015 bp, Homo sapiens
  misc_feature (1015)..(1015): n is a, c, g, or t
gaacagatggaagataccatcaatgaagaaccgtcaccaggcaccgaatctgctggcaccttgatcttggacttccccagcctccggaactgatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgccctggacccatccaaggacccctgcctgaaggtaaaatgcagccctcacaaagtgtgtgtgacccaggactaccagacccgccctgtgtgtcagccgcaagcacctgctccccaggcaaaagaaggggaacgtgggcccagaaacactggggttggacctttcgaatttggtcaagtgcaagccctgtcccgtggcacagtcagccatggtctgcggctcaaatggccactcctacacatccaagtgcaaattggaagttcatgcttgttctactggcaaaagcctcgccacccttctgtgatgggccctgtccctggctcccagagcctgaagccacaaagcacagggcaaaaaaagagtgccctgcccaaacaaggaatttgcggaaaccttgcccccccggcctaaaggattggccttgcaactttcccccaaggaattccaccctatttactcaagccgcccccttttccgcctgtttttcaaggcacgtttcgcccattaacacaacctgtcttn

SEQ ID NO: 736438 - DNA, 192 bp, Homo sapiens
  misc_feature (55)..(55): n is a, c, g, or t
cagcttgatgctgcaggtcatctagagatcccccagcagcatagatattaccgcncttaggatttctctccctatcaagctggcccagatacaagtaccaaacagtagtctctgaagttcccccatttccttcagtaccagtctataagctactgtttggtacttgtatctgggccagcttgatagggagag

SEQ ID NO: 736439 - DNA, 798 bp, Homo sapiens
gcggccgcctactactactactactgctcgaattcaagcttctaacgatgtacggggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaaaaaaaaaaaacgacacaccacaaaaacaaacgtgtgttgcgggcgcgcccttcggccccctggagaaaagagctttctcaaagaacccatttccgttgtgggcgcggcggggcccccagatgatgtatagcggtgacaccggggtccaaaacgagtgtccccaaaagaaaaaccgcgggcaagaaaaggtcgcgggtttcctcacccaattaaaaaaaggcgcgggggacaaaccacgctgtcgtgaacaatcccgag

SEQ ID NO: 736440 - DNA, 5138 bp, Homo sapiens
cactctctgttgtccaatggacacacctgtcgtgttttgagccagcgagagatgcagtggaagtgaaaagcatggttacagactccccatgcgacagtacactcttctgaagtagcggacgcctggttagcttgacattctatgcaaagatccataatgtggttcctgcagatggcacagttatcaaccacaatatcccaggcccagagggctactgcattccactttttcacttcaaagcgcttcttgcccgcgccgctgttggtgccgctcggggtatccacatccatcgctgcgggctcacaaagcggccagacgctcggcggcggcgtgtggcaggagcgcaggggcgcgagccggcgatcagccttcccggcgaccgtgccgcgggagctcgagcaactcggactaggggacccgggccggcccccaagatgccggcgatcgcggtgttggcggcggccgccgcggcgtggtgcttcctccaagtcgagagccggcacctggacgcgctcgccggaggcgcgggccccaaccacggcaatttcctagacaatgaccagtggctgagcaccgtctcccagtacgaccgggacaagtactggaaccgctttcgagacgatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtagtgcccacaagaaagaggacacaagttttgcacaaaattgcaagtcacttcctattcctgcatttgtatctaagactccaaggcaccaaggtctcttctccattgttgctctctatacccgacctaaggtttggaagacaactgcttgttcccagaggattctgattttgcatatgtttgtatgggagaaagggtgttgtgtttttttttttgttgttgtttattttttggatagggaagtcattggcttaattagagcctccttcctttctgtgagatttttccaacaagcatgtgatttacgtggaattctgacagtgcagggagcccccaccctcttaaatgtcaaagaccctttttgattacccacactggtggttattacagcatggttcccagccttacagtgtctaagtgcttctcttgtgtcctgtagatgttgtgaaaaagaaaaaaacaaaaaatacaccacactgtactttttccccctgcccccgttactgccggtgattattattaaaaattagtttttttcacatcattatatctggcttcctataaacaacagccttaattcagtcaagactccctttggggaattcattttattaaaaattggtgtctggatacttccctgtacatgcataaatatgcatgcatgtacagaaagactgtatgtgtgtgccttgcacacacacccatacctctcagaaaaagtgtttgggtatcttaaaaactcgaaaaacaatgataaatttctcagcttgtccagacctggaacaaaatttctggaataagaaatttgtattaaagtccttttttgcactaacagttggctcttgtagcctgcaggctgaggaagtctcttctctgtgcatcagcagagttactgaaagcctctgattgagaaaaaacctccgtctgcctaaatcacttttctcgcagaagccatgcgactcccacacgacacgggcagcttcacaagccatctctttcatttctgcttgaagcccccttggctgcagcaatcctgtctgccataggtttcttccttccttacctactcaagggctttttctaaggcatgcacacatatctcctgttctctgagagtaccatggtgttccttaaaagaagaaaatttctaattctgaactcaatgttttgcttttactccctttctactgacaaatcatgataagggcacaaaagctgtacagatttttttttttaaccactcaatcccaaatggaggcctacaaagaacatcgtaataacacatggaagcaaaccctgggtttttaagagcaaattctgtccccccctcactcccccaagtgacaagatactaatgaagaaagttcttcaccatagtgtttgttttaactaaactcattggagtctagttccaaatttggtagggtcatcatctctacattccttaggatttctctccctatcaagctggcccagatacaagtaccaaacagtagtctctgaagttcccccatttccttcagtaccagtctataagctactgtccgccactgattttcatctatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttaatgatggagaagagtgctcaacagacagttcccagtaaggtaatgagatgccattttcagagacattctaagaagatattttgattcattaaaacattaaataaaaagccctcctcagattggaacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaatatctgagtgtttgtatttcattggg

SEQ ID NO: 736441 - DNA, 5370 bp, Homo sapiens
cactctctgttgtccaatggacacacctgtcgtgttttgagccagcgagagatgcagtggaagtgaaaagcatggttacagactccccatgcgacagtacactcttctgaagtagcggacgcctggttagcttgacattctatgcaaagatccataatgtggttcctgcagatggcacagttatcaaccacaatatcccaggcccagagggctactgcattccactttttcacttcaaagcgcttcttgcccgcgccgctgttggtgccgctcggggtatccacatccatcgctgcgggctcacaaagcggccagacgctcggcggcggcgtgtggcaggagcgcaggggcgcgagccggcgatcagccttcccggcgaccgtgccgcgggagctcgagcaactcggactaggggacccgggccggcccccaagatgccggcgatcgcggtgttggcggcggccgccgcggcgtggtgcttcctccaagtcgagagccggcacctggacgcgctcgccggaggcgcgggccccaaccacggcaatttcctagacaatgaccagtggctgagcaccgtctcccagtacgaccgggacaagtactggaaccgctttcgagacgatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtagtgcccacaagaaagaggacacaagttttgcacaaaattgcaagtcacttcctattcctgcatttgtatctaagactccaaggcaccaaggtctcttctccattgttgctctctatacccgacctaaggtttggaagacaactgcttgttcccagaggattctgattttgcatatgtttgtatgggagaaagggtgttgtgtttttttttttgttgttgtttattttttggatagggaagtcattggcttaattagagcctccttcctttctgtgagatttttccaacaagcatgtgatttacgtggaattctgacagtgcagggagcccccaccctcttaaatgtcaaagaccctttttgattacccacactggtggttattacagcatggttcccagccttacagtgtctaagtgcttctcttgtgtcctgtagatgttgtgaaaaagaaaaaaacaaaaaatacaccacactgtactttttccccctgcccccgttactgccggtgattattattaaaaattagtttttttcacatcattatatctggcttcctataaacaacagccttaattcagtcaagactccctttggggaattcattttattaaaaattggtgtctggatacttccctgtacatgcataaatatgcatgcatgtacagaaagactgtatgtgtgtgccttgcacacacacccatacctctcagaaaaagtgtttgggtatcttaaaaactcgaaaaacaatgataaatttctcagcttgtccagacctggaacaaaatttctggaataagaaatttgtattaaagtccttttttgcactaacagttggctcttgtagcctgcaggctgaggaagtctcttctctgtgcatcagcagagttactgaaagcctctgattgagaaaaaacctccgtctgcctaaatcacttttctcgcagaagccatgcgactcccacacgacacgggcagcttcacaagccatctctttcatttctgcttgaagcccccttggctgcagcaatcctgtctgccataggtttcttccttccttacctactcaagggctttttctaaggcatgcacacatatctcctgttctctgagagtaccatggtgttccttaaaagaagaaaatttctaattctgaactcaatgttttgcttttactccctttctactgacaaatcatgataagggcacaaaagctgtacagatttttttttttaaccactcaatcccaaatggaggcctacaaagaacatcgtaataacacatggaagcaaaccctgggtttttaagagcaaattctgtccccccctcactcccccaagtgacaagatactaatgaagaaagttcttcaccatagtgtttgttttaactaaactcattggagtctagttccaaatttggtagggtcatcatctctacattccttaggatttctctccctatcaagctggcccagatacaagtaccaaacagtagtctctgaagttcccccatttccttcagtaccagtctataagctactgtccgccactgattttcatctatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttaatgatggagaagagtgctcaacagacagttcccagtaaggtaatgagatgccattttcagagacattctaagaagatattttgattcattaaaacattaaataaaaagccctcctcagattggaacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaaaaaaaaaaaacgacacaccacaaaaacaaacgtgtgttgcgggcgcgcccttcggccccctggagaaaagagctttctcaaagaacccatttccgttgtgggcgcggcggggcccccagatgatgtatagcggtgacaccggggtccaaaacgagtgtccccaaaagaaaaaccgcgggcaagaaaaggtcgcgggtttcctcacccaattaaaaaaaggcgcgggggacaaaccacgctgtcgtgaacaatcccgag

SEQ ID NO: 736442 - DNA, 3883 bp, Homo sapiens
cactctctgttgtccaatggacacacctgtcgtgttttgagccagcgagagatgcagtggaagtgaaaagcatggttacagactccccatgcgacagtacactcttctgaagtagcggacgcctggttagcttgacattctatgcaaagatccataatgtggttcctgcagatggcacagttatcaaccacaatatcccaggcccagagggctactgcattccactttttcacttcaaagcgcttcttgcccgcgccgctgttggtgccgctcggggtatccacatccatcgctgcgggctcacaaagcggccagacgctcggcggcggcgtgtggcaggagcgcaggggcgcgagccggcgatcagccttcccggcgaccgtgccgcgggagctcgagcaactcggactaggggacccgggccggcccccaagatgccggcgatcgcggtgttggcggcggccgccgcggcgtggtgcttcctccaagtcgagagccggcacctggacgcgctcgccggaggcgcgggccccaaccacggcaatttcctagacaatgaccagtggctgagcaccgtctcccagtacgaccgggacaagtactggaaccgctttcgagacgatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtagtgcccacaagaaagaggacacaagttttgcacaaaattgcaagtcacttcctattcctgcatttgtatctaagactccaaggcaccaaggtctcttctccattgttgctctctatacccgacctaaggtttggaagacaactgcttgttcccagaggattctgattttgcatatgtttgtatgggagaaagggtgttgtgtttttttttttgttgttgtttattttttggatagggaagtcattggcttaattagagcctccttcctttctgtgagatttttccaacaagcatgtgatttacgtggaattctgacagtgcagggagcccccaccctcttaaatgtcaaagaccctttttgattacccacactggtggttattacagcatggttcccagccttacagtgtctaagtgcttctcttgtgtcctgtagatgttgtgaaaaagaaaaaaacaaaaaatacaccacactgtactttttccccctgcccccgttactgccggtgattattattaaaaattagtttttttcacatcattatatctggcttcctataaacaacagccttaattcagtcaagactccctttggggaattcattttattaaaaattggtgtctggatacttccctgtacatgcataaatatgcatgcatgtacagaaagactgtatgtgtgtgccttgcacacacacccatacctctcagaaaaagtgtttgggtatcttaaaaactcgaaaaacaatgataaatttctcagcttgtccagacctggaacaaaatttctggaataagaaatttgtattaaagtccttttttgcactaacagttggctcttgtagcctgcaggctgaggaagtctcttctctgtgcatcagcagagttactgaaagcctctgattgagaaaaaacctccgtctgcctaaatcacttttctcgcagaagccatgcgactcccacacgacacgggcagcttcacaagccatctctttcatttctgcttgaagcccccttggctgcagcaatcctgtctgccataggtttcttccttccttacctactcaagggctttttctaaggcatgcacacatatctcctgttctctgagagtaccatggtgttccttaaaagaagaaaatttctaattctgaactcaatgttttgcttttactccctttctactgacaaatcatgataagggcacaaaagctgtacagatttttttttttaaccactcaatcccaaatggaggcctacaaagaacatcgtaataacacatggaagcaaaccctgggtttttaagagcaaattctgtccccccctcactcccccaagtgacaagatactaatgaagaaagttcttcaccatagtgtttgttttaactaaactcattggagtctagttccaaatttggtagggtcatcatctctacattccttaggatttctctccctatcaagctggcccagatacaagtaccaaacagtagtctctgaagttcccccatttccttcagtaccagtctataagctactgtccgccactgattttcatctatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctagtttgttcaagagagagaccatgtacgagaagggccgagctgattat

SEQ ID NO: 736443 - DNA, 1267 bp, Homo sapiens
gaggagagagatagagagagagagagatagacacgagggcctttttacctcagattggaacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaaaaaaaaaaaacgacacaccacaaaaacaaacgtgtgttgcgggcgcgcccttcggccccctggagaaaagagctttctcaaagaacccatttccgttgtgggcgcggcggggcccccagatgatgtatagcggtgacaccggggtccaaaacgagtgtccccaaaagaaaaaccgcgggcaagaaaaggtcgcgggtttcctcacccaattaaaaaaaggcgcgggggacaaaccacgctgtcgtgaacaatcccgag

SEQ ID NO: 736444 - DNA, 2232 bp, Homo sapiens
  misc_feature (55)..(55): n is a, c, g, or t
cagcttgatgctgcaggtcatctagagatcccccagcagcatagatattaccgcncttaggatttctctccctatcaagctggcccagatacaagtaccaaacagtagtctctgaagttcccccatttccttcagtaccagtctataagctactgtccgccactgattttcatctatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttaatgatggagaagagtgctcaacagacagttcccagtaaggtaatgagatgccattttcagagacattctaagaagatattttgattcattaaaacattaaataaaaagccctcctcagattggaacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaaaaaaaaaaaacgacacaccacaaaaacaaacgtgtgttgcgggcgcgcccttcggccccctggagaaaagagctttctcaaagaacccatttccgttgtgggcgcggcggggcccccagatgatgtatagcggtgacaccggggtccaaaacgagtgtccccaaaagaaaaaccgcgggcaagaaaaggtcgcgggtttcctcacccaattaaaaaaaggcgcgggggacaaaccacgctgtcgtgaacaatcccgag

SEQ ID NO: 736445 - DNA, 1054 bp, Homo sapiens
gtacccgaaatggaacgaacgaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaaaaaaaaaaaacgacacaccacaaaaacaaacgtgtgttgcgggcgcgcccttcggccccctggagaaaagagctttctcaaagaacccatttccgttgtgggcgcggcggggcccccagatgatgtatagcggtgacaccggggtccaaaacgagtgtccccaaaagaaaaaccgcgggcaagaaaaggtcgcgggtttcctcacccaattaaaaaaaggcgcgggggacaaaccacgctgtcgtgaacaatcccgag

SEQ ID NO: 736446 - DNA, 801 bp, Homo sapiens
gcggccgctactactactaattcgcggccgtcagaccgttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaaaaaaaaaaaacgacacaccacaaaaacaaacgtgtgttgcgggcgcgcccttcggccccctggagaaaagagctttctcaaagaacccatttccgttgtgggcgcggcggggcccccagatgatgtatagcggtgacaccggggtccaaaacgagtgtccccaaaagaaaaaccgcgggcaagaaaaggtcgcgggtttcctcacccaattaaaaaaaggcgcgggggacaaaccacgctgtcgtgaacaatcccgag

SEQ ID NO: 736447 - DNA, 4529 bp, Homo sapiens
cttcctgcttctgcccctcaccaagaccctccaccagcaaaaaggtcatgactttctgaaggctcagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtagtgcccacaagaaagaggacacaagttttgcacaaaattgcaagtcacttcctattcctgcatttgtatctaagactccaaggcaccaaggtctcttctccattgttgctctctatacccgacctaaggtttggaagacaactgcttgttcccagaggattctgattttgcatatgtttgtatgggagaaagggtgttgtgtttttttttttgttgttgtttattttttggatagggaagtcattggcttaattagagcctccttcctttctgtgagatttttccaacaagcatgtgatttacgtggaattctgacagtgcagggagcccccaccctcttaaatgtcaaagaccctttttgattacccacactggtggttattacagcatggttcccagccttacagtgtctaagtgcttctcttgtgtcctgtagatgttgtgaaaaagaaaaaaacaaaaaatacaccacactgtactttttccccctgcccccgttactgccggtgattattattaaaaattagtttttttcacatcattatatctggcttcctataaacaacagccttaattcagtcaagactccctttggggaattcattttattaaaaattggtgtctggatacttccctgtacatgcataaatatgcatgcatgtacagaaagactgtatgtgtgtgccttgcacacacacccatacctctcagaaaaagtgtttgggtatcttaaaaactcgaaaaacaatgataaatttctcagcttgtccagacctggaacaaaatttctggaataagaaatttgtattaaagtccttttttgcactaacagttggctcttgtagcctgcaggctgaggaagtctcttctctgtgcatcagcagagttactgaaagcctctgattgagaaaaaacctccgtctgcctaaatcacttttctcgcagaagccatgcgactcccacacgacacgggcagcttcacaagccatctctttcatttctgcttgaagcccccttggctgcagcaatcctgtctgccataggtttcttccttccttacctactcaagggctttttctaaggcatgcacacatatctcctgttctctgagagtaccatggtgttccttaaaagaagaaaatttctaattctgaactcaatgttttgcttttactccctttctactgacaaatcatgataagggcacaaaagctgtacagatttttttttttaaccactcaatcccaaatggaggcctacaaagaacatcgtaataacacatggaagcaaaccctgggtttttaagagcaaattctgtccccccctcactcccccaagtgacaagatactaatgaagaaagttcttcaccatagtgtttgttttaactaaactcattggagtctagttccaaatttggtagggtcatcatctctacattccttaggatttctctccctatcaagctggcccagatacaagtaccaaacagtagtctctgaagttcccccatttccttcagtaccagtctataagctactgtccgccactgattttcatctatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttaatgatggagaagagtgctcaacagacagttcccagtaaggtaatgagatgccattttcagagacattctaagaagatattttgattcattaaaacattaaataaaaagccctcctcagattggaacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaaaaaaaaaaaacgacacaccacaaaaacaaacgtgtgttgcgggcgcgcccttcggccccctggagaaaagagctttctcaaagaacccatttccgttgtgggcgcggcggggcccccagatgatgtatagcggtgacaccggggtccaaaacgagtgtccccaaaagaaaaaccgcgggcaagaaaaggtcgcgggtttcctcacccaattaaaaaaaggcgcgggggacaaaccacgctgtcgtgaacaatcccgag

SEQ ID NO: 736448 - DNA, 1292 bp, Homo sapiens
gagagggaacctgcagaccccaggggccagcctttgcctgattcctgaatttgttaaagccattttatgtagtgtggaaggtgcttcactgaagagcctcctcctcaccccagcagcctcctcccaggcagacccacccctgccatccccaacctgagacccttgaccttttcaccttgcactctgagctacctggcaccccaaaactcctcctggtagtggggttgagctcttgtaaggagcctgaggaagaaagaccagtattgggagctcatgtcccagcccctcatgcacagttcacctagactagagccaggaagtttagggagtcccagtgcatggctaggggtgccctgagggcgctgtctgaacctcaggctgtcacagttcatcaatcagccagccatgcacctgtcaggtgtgcctgccaacagcctgccccatctttctcatcctcccagccaaggcagaccactccagagggacctgcacagccccttcctcaagaccaccacaggaggcctgggagtgagaagggtcacggtgctgggtgcctgggttcctcagcaccggccactcccactttgccctggtgtgcccatcaggcccagagaagaaacccgctctgggcgtcttactttttactcttattcagaaaaaccttccttagccttttctttgtttctgacagcaaaatcaaaggaaattcaagatgaaattttaggccagagcctggcctaaaaactgcaagtgttcataattaacaaaagaaatctaaaaaaagagatgatgtgttgccgctcccctgcagctgtggaggaaggagagctgttctgcatccataaaaaccagttaaaagggatttcataaggtctgaaattgagaactttcccaagaatactgcatcttgttctcttgtgcaatatacagacgtgtgaatattcctaacagtaaccaaatgggtgcactctctgtgaaaacgcatctttcaaagagttttttaaacaaaggagactcctgggcctttagaaataattgccacaaactgcaaaaacaatctccaacctcccacttctgtaattctcatctgttgtcttactagaaaatttatttctctggtaataatgttataattgatatccctgtcttctcaagatgtaaaatacttgtaaaaacttctctgtccatcagaaaataattattggcacttttcttctctctcatgtgcatgatggaacaataaaaagcttatggctttgctagatctattatttaacaaacaatttgagagt

SEQ ID NO: 736449 - DNA, 417 bp, Homo sapiens; identical to SEQ ID NO: 7665

SEQ ID NO: 736450 - DNA, 606 bp, Homo sapiens
atacctaatattatacctaataatagtaattatagttgcttactgataacaacaactaataacacttattgaggccctactctgtgccagggattttctaatcacttaattccctaacacattatgaggttttattgttttctccaattttacagacagggaaactgagacatggagtagttaagttcatttacccagtgtaacacagctggcagtctggttttagattttgtccaatgcacactgtgtggcactgcccaggagcataagctccttcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcc

SEQ ID NO: 736451 - DNA, 4989 bp, Homo sapiens
cgcccccctccggccagcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttggagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccttcttgaccttgcaagagagtttctgcccattttagagccacgttaccaaatcgatgtaggcctaatcacttcctcaaccctgttcaagcgtccctcccttgtgctcagtatattggtgtgaacacggaacatgatgggggatttacctgaccagccaccccatagcccctggctgaagaagaaagagcatcttctctcccactgcaccccttctcctccaagaatagttgcccacattcccaaaatgtggaaagacttttcttttccttccggaacatgttcttcaccaccttttggagatttaaccatagctgccaaagctatgcacccagttggccttagaaaaccacaatgtttacagccctgtcttagggccgcggcttctcttatcttccaccaccttccttgcttgcagggttatcttctcacagggctggaatgcaaatttcagaggcttcttttgaagattccccaagtcaagcaggcaagatgcctagatcttctgttatctttgacatgtaacatcctttttagaggctcagaacacctccttggctgctatctcatgtgttagaatccagtttgtggtgaacctctttggaaggggaccccctctctttaaaccctgttcctctgtcctggtaacattctccttctaggagagcctctcttctgagaaggtaaaggaagggctgggtgagacacacagctatcctaggagccgtaggaagacaaaacttcccttttgttttactcctcactcctctatttttgttttactcacttctttatattttgttttactcctcactcctgtatattttggtttacttactcctctatttcagaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagatttttttttttaatgtgtaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcctgttccctatgtgtaaacaaagattccagggcgtggttttgcactcctgttgtactcttttagaggtggaaaagaggtggatactgagatctaagaggaaaggatagtcattcacgttctgagatatgcgctctctctattgttctcgtacacaaagggatagtctcttttctggagctgatgtccctgcttggaggttagccccaaaacatggctcttgtattgttctaagagaaaaggctttcattttggttcttctgattggtgttacctactgcctaatatgtgttcattttttgacagagaggcagactattgaaaaagtctgtgtgaacagagagcagttcattaagcccattgctttcagtaatgtggccttgaccccttctgcttcccccttctcccatggagcatggcagggcttggttatttagagtccatacatgcaagccattgagagacttgtttgctcaaatgcaagtttgctcaaaaacaggtcctgaaggcttgcttaggattacagggatgctgggtaagaacaccgttcctctctctcgctggagaaatccctgtttctctgactccctttgtgatcctcacagtaatgtattctgtgccactgtaggacacaaggctctgggccagtagaacaggcagagaggtgacactgggcagcaagctgagagctctttctaaatggagtgaaggaattcagtggcctagtttcgccattctctaatgagaaaccaaggccaggctgaaaagtgcaattagatgtggtggattgtggtaacggcctccagataaaggggttatccctgtggaagtgacttttccccatttgatcccttttcaactctaaatggccaggcccagagcagaagaagggttgggtctggaaggaaggctccaaaggatgaaagcttctccctgatcataaggaagtgcatctttatagaattgttgtgcataatgtcagtaaatccctctcacttgacaagggactggattcatcttgccttgagacgggccagtagttatcagtgagtcaaagcaaagtgaaagtttcaggagatgggaccaatggtgcaatgctcgccataacaaaattccttaaaaataaaaaagctaatgttatagcaacaaaaaaagactgaagcaaaaccacactgaaatgcatcccactccaggagaggaattcttagcgtaacactctaaataaatggaaggaatcatcaccttccttattttacctctgccttgttcaccaggctgcccagtgcttaccatgcagaaagcagtcagctgtactctggaagtttctgttcttctttcctggggcttaggatattctgggagctgtctgagccttgtgcctaaggcttatcaggtgatataatcttcctgttctgggctgcttgctggaggaataggaagtgacatttataagacacaggcggtgtgagcatccatgtgtggtcttggtctaaaccagctcttgaacaggttaaagcaaacagcaataacaaaacaaaaactactgatgctgagcgttttgatcctagtaatatttcaaatattgtccttctgcatatgttctatccatatttgattccaatatacattattaagctttcttgggtactattttgctggggctcttgcgtgaaggtggtacctgtctcatgatccttaaaagagagaggcttttttcatccaaagctgtagtgttgggaactggggtgggagaggcactttttggaattctgaaagaatcatatctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcc

SEQ ID NO: 736452 - DNA, 4433 bp, Homo sapiens
cgcccccctccggccagcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttggagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccttcttgaccttgcaagagagtttctgcccattttagagccacgttaccaaatcgatgtaggcctaatcacttcctcaaccctgttcaagcgtccctcccttgtgctcagtatattggtgtgaacacggaacatgatgggggatttacctgaccagccaccccatagcccctggctgaagaagaaagagcatcttctctcccactgcaccccttctcctccaagaatagttgcccacattcccaaaatgtggaaagacttttcttttccttccggaacatgttcttcaccaccttttggagatttaaccatagctgccaaagctatgcacccagttggccttagaaaaccacaatgtttacagccctgtcttagggccgcggcttctcttatcttccaccaccttccttgcttgcagggttatcttctcacagggctggaatgcaaatttcagaggcttcttttgaagattccccaagtcaagcaggcaagatgcctagatcttctgttatctttgacatgtaacatcctttttagaggctcagaacacctccttggctgctatctcatgtgttagaatccagtttgtggtgaacctctttggaaggggaccccctctctttaaaccctgttcctctgtcctggtaacattctccttctaggagagcctctcttctgagaaggtaaaggaagggctgggtgagacacacagctatcctaggagccgtaggaagacaaaacttcccttttgttttactcctcactcctctatttttgttttactcacttctttatattttgttttactcctcactcctgtatattttggtttacttactcctctatttcagaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagatttttttttttaatgtgtaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcctgttccctatgtgtaaacaaagattccagggcgtggttttgcactcctgttgtactcttttagaggtggaaaagaggtggatactgagatctaagaggaaaggatagtcattcacgttctgagatatgcgctctctctattgttctcgtacacaaagggatagtctcttttctggagctgatgtccctgcttggaggttagccccaaaacatggctcttgtattgttctaagagaaaaggctttcattttggttcttctgattggtgttacctactgcctaatatgtgttcattttttgacagagaggcagactattgaaaaagtctgtgtgaacagagagcagttcattaagcccattgctttcagtaatgtggccttgaccccttctgcttcccccttctcccatggagcatggcagggcttggttatttagagtccatacatgcaagccattgagagacttgtttgctcaaatgcaagtttgctcaaaaacaggtcctgaaggcttgcttaggattacagggatgctgggtaagaacaccgttcctctctctcgctggagaaatccctgtttctctgactccctttgtgatcctcacagtaatgtattctgtgccactgtaggacacaaggctctgggccagtagaacaggcagagaggtgacactgggcagcaagctgagagctctttctaaatggagtgaaggaattcagtggcctagtttcgccattctctaatgagaaaccaaggccaggctgaaaagtgcaattagatgtggtggattgtggtaacggcctccagataaaggggttatccctgtggaagtgacttttccccatttgatcccttttcaactctaaatggccaggcccagagcagaagaagggttgggtctggaaggaaggctccaaaggatgaaagcttctccctgatcataaggaagtgcatctttatagaattgttgtgcataatgtcagtaaatccctctcacttgacaagggactggattcatcttgccttgagacgggccagtagttatcagtgagtcaaagcaaagtgaaagtttcaggagatgggaccaatggtgcaatgctcgccataacaaaattccttaaaaataaaaaagctaatgttatagcaacaaaaaaagactgaagcaaaaccacactgaaatgcatcccactccaggagaggcactttttggaattctgaaagaatcatatctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcc

SEQ ID NO: 736453 - DNA, 3533 bp, Homo sapiens
cgcccccctccggccagcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttggagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccttcttgaccttgcaagagagtttctgcccattttagagccacgttaccaaatcgatgtaggcctaatcacttcctcaaccctgttcaagcgtccctcccttgtgctcagtatattggtgtgaacacggaacatgatgggggatttacctgaccagccaccccatagcccctggctgaagaagaaagagcatcttctctcccactgcaccccttctcctccaagaatagttgcccacattcccaaaatgtggaaagacttttcttttccttccggaacatgttcttcaccaccttttggagatttaaccatagctgccaaagctatgcacccagttggccttagaaaaccacaatgtttacagccctgtcttagggccgcggcttctcttatcttccaccaccttccttgcttgcagggttatcttctcacagggctggaatgcaaatttcagaggcttcttttgaagattccccaagtcaagcaggcaagatgcctagatcttctgttatctttgacatgtaacatcctttttagaggctcagaacacctccttggctgctatctcatgtgttagaatccagtttgtggtgaacctctttggaaggggaccccctctctttaaaccctgttcctctgtcctggtaacattctccttctaggagagcctctcttctgagaaggtaaaggaagggctgggtgagacacacagctatcctaggagccgtaggaagacaaaacttcccttttgttttactcctcactcctctatttttgttttactcacttctttatattttgttttactcctcactcctgtatattttggtttacttactcctctatttcagaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagatttttttttttaatgtgtaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcctgttccctatgtgtaaacaaagattccagggcgtggttttgcactcctgttgtactcttttagaggtggaaaagaggtggatactgagatctaagaggaaaggatagtcattcacgttctgagatatgcgctctctctattgttctcgtacacaaagggatagtctcttttctggagctgatgtccctgcttggaggttagccccaaaacatggctcttgtattgttctaagagaaaaggctttcattttggttcttctgattggtgttacctactgcctaatatgtgttcattttttgacagagaggcagactattgaaaaagtctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcc

SEQ ID NO: 736454 - DNA, 1633 bp, Homo sapiens
cgcccccctccggccagcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttggagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcc

SEQ ID NO: 736455 - DNA, 2132 bp, Homo sapiens
tgttttgattgtgtaaagagtagagtgctgatttgtgtgttacagagggtggtctgtacaagtcataaagctcgacatggccttgcttcctgctaggtgttaggacacccatgatggtggagtctcttggcattctgtgtaattagataaggctgtttatagcattggtccatgagaacttccttgtttctatttaaaatgaaaatcattgtataagtaaaacttcttaaatgtagatagaaatagaattttaactgaaattttatgaagccattggccgcagggatgtgtgtcatggaggagggctccatacttttttggtatacttatctcaaacttaattcatttgcatactgctttttctctaagtgccaactgtcctagtatattttctaagtcaacttttactttcactttatcctaagcaagaatatctttggcatcacagactcagtaagcccgtttttttctaatgcacatacaaataaataaaatgcacaacttttaacataaatggctgcctccaatttgggaaatactgttctggccagaggccgttgctctgataatgtcatgtggttagtgcattttaggaagacctcctttccctttggttgactcctgcaggacataagatatcagtgacgttatcctttgttgagccatcctggtttgagtcaggatgagtgttgagagtttttggggagttgcccctgtgtcctatattattttatcctcttaaagtctgatggtctttggctccactgactccaggtaagttggggtgacagtgcagcatatttctattttctagttgtttctggccagacatggggaaggtcaagacatcttgttcatgcaaacggattgatggccattcctaatctgattttattagtgtattttaggaagtaaagtaagattcttgagcccagctgaacttcccctattgaattttctaacaaaaagagagtttgcgtatgggtttataattgagcctgctcttgtagaaatgttttatcagaattgaaatcctctctgatccccaaattctagagacaaagttgttttctgaatttgagaaatctgttcagttcacaaggaaaggtgacaatgtgtcatttggatgttgtcccacacgtgaggcctcgttgggtgcttgtggtgggagggaccctccaggcaggctttgtatggagggttttcatgtctggacacatttctgttccgagaagcactgctgcgtttttgggagcgtggaccctggccagagcctgtggccagctctgcctgccctccctttcttggcctgctcttttgagtatgtagtggggctttgtgtggcatcctgccaggttaaagctgcatggtgcttaggatagagctggtgctgtggggaggctcttgatgatgggggctgccatctatttgcctgttaactcttagaaaccaaacctcaaatgtcagaatttcctttctagaagaggctggttgaataggaaccagaaaggccctcatacaggcagggctgttcactcctcttgacttgcgtgtttgtgccttccttgtaggaaggcttcttagggaattgttatctgtttaggggaaataagcctgcaggaatgaacttttttttaaaataaaaactcttgatcaaaaatggaaagaaaaaaaccagtgaaacaggctaggtagtttgtggaattctcctttgcaggtgaggggagaaagcagctatctcaagggcacagctacagattgggagctggggcttccatccagggtctgggacacccaaaccttaggcttgcccctcccgggaggcctccccctcagagctatgtgggatgcagttgcctttttacctgtgatgagaaactggtgaattgccaggattctggctctggcttcagtctgcccctttccggggattagagggcattaaccctacttcctacagccaagcagctcttcctcatgactctactttctaactccgggggttgactgattgatttgaagaccgccttgttgatgaatgtgttgaaacttgctatcataatgtaaatgctccttaataaaataacaggacctggtgggttcagttgccttgcccacgtgtgaaaaaaaaa

SEQ ID NO: 736456 - DNA, 1427 bp, Homo sapiens; identical to SEQ ID NO: 424435

SEQ ID NO: 736457 - DNA, 9253 bp, Homo sapiens
gagttatttctcctatacctatgcaaagtaggaagagcaccttataggaggcactgtatagggacaggggacatgggatcagccataggaatgttaaatgaaattgcacagaggaaagtttaatatatgtctagagattatacatacacttttttaagcgtaaaaagaagacatctagtaatgacagatattctttttatatacaagcaaaagaaagtataaggaggttctacagtgcaacatccacaatctgtgcattcacatattatgggacttttattttttaaactctcatataaattttttaaaattactccttggaagagatcctggtttttttcttcatttatttttttctttaaaaacatttattttaagagaagagaaaaagagcttcatctaattttgcatcttgattaccaatcagtactagtcacagcaccagcaatactgtatgttttagactgacaaggtcagccaggaaatggcatttttttaaacgcagaaatgtgtttgtttcctctactctaacacgtcctttctcctcctggtgtcctgtcaccccccatgcagcaccactgatgcgagatgatgctctggcctggtccaggaagccctgagccatgggcagattgcccagtggccttgggcggccagagcttgtcacctgtttaaacaagttcaccatgtgtttaaatgacagggtacagtcctggaccagaggtttttctcttcagcaaagctccctggcccttgatcgttggactgttactaatagaaaaagattcaagtcatgaagtataaaatccatcccccatcccagaactttgaaacacaaggagggagagatctttgctatggagcagtcctggagcaaagccccgtggcttccacccccagatatataccccataagtagtgctgagctccagcttagctgagccaagctcagtccttatctggtgttcagccagtgcacaggtataagcagaactacagagctgaatgtagcttccctgggatctcttctcctttctaaagcatttttcacacagttctgtacctcctacggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtatgatattacctgacacgtaagttttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgcttccttcatttagatggactaagttattttaaactctatcttacatcagagtcctgatggtgttgggatagtcactgaccctttcacgtatgtaataagatacgtctcgttcacacactatttcatttgatctttgtaagaacccagtgtagaataggaatatttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaggagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatgaagaaagaaagaagaaagctatggttccgaaagcaggtaaccacagattttgaaaggaggcagagatggtgattaaactgtagtccttgttttttaaaatgttctttcatgttaggcaccaccacatagttaataactaccaacttctaaagagaagatccccttgatttatttatatcatgaaaatactaaaaatcaattctcaagtctaattaactattacattatcttgctaggtccttttccctaaatttttaattcagaaaattaaccagaattggccagatgcagtggttcacgcctataatcccagcactttgggagtccaaggcagatggatcacttgaggtcagtagttcaagaccagcctggccaacagaggaagaaagagtgaaaacaaaagaagaaagagggaaaccctgtctttactaaaaatacaaaaattagtcgggcgtggtggcgcacacctgtaattccagctacttgagaggctgaggcaggagaatcccttgaaactgcaggcagaggttgcagtgagccaagatttcactgctgcacctggggtgagactaccattaaggaaggaaatttcctttaaacagaaaaaaacaaaggtgctcatctatttcttctgaattctctctacatccttgacttaagaggaaaaccagcactcaagaaacagctttaaaagagaacagtccccattctagctaccagtcttgctttcccccatcttggcaagccccagtgaatttgccattgaaagattaccctcccctttgccctcatctgcctgagctagaggccaggctgttgttaatgttttttcagttccaaagcccctgatgggacattcttgtttctgtgctactgctttctctctcttaaattaaggtgcaaggggataaatattactataactgggatgtaaggctcagtcagtgtggctattccctcccttcgggggaaatattccatctgtctgaacggttttaggtgatcatgaggagagcggcttagtcacacagccagccacgctcatcacaaaagatttgttcagactcactgtaaagaatgacaaggcagatagctaatcctttcactgtgcctcaaagcccgccgtgcaagtcaccaaccctaccggtcctctccacgtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgcttctaaaaaaaaaaa

SEQ ID NO: 736458 - DNA, 9142 bp, Homo sapiens
ggagccctggccaccgcagggagctcagaggccaatctacgcaaaaggcatgcaaaacaatggattctggtcccaaaatatttctaagtaaggcatgatgtagccttttgattttttttttatcctttgacaccccagccttcagaaaaggtttttcatctctctccaaagaagtcatttcatagtgactgacaggacattctccagagagcgacaaagcagagtggccagcaggcagtggtgttaagccttgggccttcccagcagatgtgtgctgcattggtgggtgggaggcagtgtgacagcctggagaaaacacacaggtagcaagggagtcaggggggaggtacaagagggctgtggacacctggctcttgctcatcttcttggtgctgatcagctggtggtcaccatccctaagtacctcccagggagctgccattttctcctctgggagcagctgcctgaagcaaggagagaatgacctgaagggaagtacctccggccaagagtgcagggctgctgtgcctagcctgagcgggccatctctagcagatatggacttctctccaccacactagctgaaaagttttctcccttggttggcaaaagccagtgtcaggaaaaaagctgtgggtttctgaccaagaatgtgtgcgcttagctgcaaagtgcctgtcagcagctccaggcaccaacaaggtgcccttttattagacaattcctgcccgaacataaccatattgcagatgaaaattttcaatagagaatgacacaattcttgacctttctaaaaacttttcaaagagatagtcacatgtgtatatgttgcaaaagatttttgaaactgaaatgtcctccattaaatctcaagagcactcgagttttaagtctgctgtttctggtgtcacactaagacacacttttgaaagcagccctgggttctgaattagttggcaggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtatgatattacctgacacgtaagttttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgcttccttcatttagatggactaagttattttaaactctatcttacatcagagtcctgatggtgttgggatagtcactgaccctttcacgtatgtaataagatacgtctcgttcacacactatttcatttgatctttgtaagaacccagtgtagaataggaatatttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaggagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatgaagaaagaaagaagaaagctatggttccgaaagcaggtaaccacagattttgaaaggaggcagagatggtgattaaactgtagtccttgttttttaaaatgttctttcatgttaggcaccaccacatagttaataactaccaacttctaaagagaagatccccttgatttatttatatcatgaaaatactaaaaatcaattctcaagtctaattaactattacattatcttgctaggtccttttccctaaatttttaattcagaaaattaaccagaattggccagatgcagtggttcacgcctataatcccagcactttgggagtccaaggcagatggatcacttgaggtcagtagttcaagaccagcctggccaacagaggaagaaagagtgaaaacaaaagaagaaagagggaaaccctgtctttactaaaaatacaaaaattagtcgggcgtggtggcgcacacctgtaattccagctacttgagaggctgaggcaggagaatcccttgaaactgcaggcagaggttgcagtgagccaagatttcactgctgcacctggggtgagactaccattaaggaaggaaatttcctttaaacagaaaaaaacaaaggtgctcatctatttcttctgaattctctctacatccttgacttaagaggaaaaccagcactcaagaaacagctttaaaagagaacagtccccattctagctaccagtcttgctttcccccatcttggcaagccccagtgaatttgccattgaaagattaccctcccctttgccctcatctgcctgagctagaggccaggctgttgttaatgttttttcagttccaaagcccctgatgggacattcttgtttctgtgctactgctttctctctcttaaattaaggtgcaaggggataaatattactataactgggatgtaaggctcagtcagtgtggctattccctcccttcgggggaaatattccatctgtctgaacggttttaggtgatcatgaggagagcggcttagtcacacagccagccacgctcatcacaaaagatttgttcagactcactgtaaagaatgacaaggcagatagctaatcctttcactgtgcctcaaagcccgccgtgcaagtcaccaaccctaccggtcctctccacgtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgcttctaaaaaaaaaaa

SEQ ID NO: 736459 - DNA, 8596 bp, Homo sapiens
gcacgaggactcacgtaaggctttttctgaatgtaattgtgaatacaaagccttgctggtcctttttatcattacccaatggatgactgtttattagctatcagcagaattccgtaggcgaaagcaagccgtgaacgatgtacattttgctttaatagcatgttagcgaacaaacttccatggacttttgtggacaaggtgctgctttttctcatgaccctgtagaattgctatcgaccacatcttctgtagcactgacctgtgtgaactcagggaagaatttgtgcatacaaatgagtggaaacagagcaggattcatgaatatgaatgagaatgtgaatcattttggagaatgccctgggcacacgggtcaactggaaatttcatttctctaagaaagtagccctaccagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtatgatattacctgacacgtaagttttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgcttccttcatttagatggactaagttattttaaactctatcttacatcagagtcctgatggtgttgggatagtcactgaccctttcacgtatgtaataagatacgtctcgttcacacactatttcatttgatctttgtaagaacccagtgtagaataggaatatttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaggagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatgaagaaagaaagaagaaagctatggttccgaaagcaggtaaccacagattttgaaaggaggcagagatggtgattaaactgtagtccttgttttttaaaatgttctttcatgttaggcaccaccacatagttaataactaccaacttctaaagagaagatccccttgatttatttatatcatgaaaatactaaaaatcaattctcaagtctaattaactattacattatcttgctaggtccttttccctaaatttttaattcagaaaattaaccagaattggccagatgcagtggttcacgcctataatcccagcactttgggagtccaaggcagatggatcacttgaggtcagtagttcaagaccagcctggccaacagaggaagaaagagtgaaaacaaaagaagaaagagggaaaccctgtctttactaaaaatacaaaaattagtcgggcgtggtggcgcacacctgtaattccagctacttgagaggctgaggcaggagaatcccttgaaactgcaggcagaggttgcagtgagccaagatttcactgctgcacctggggtgagactaccattaaggaaggaaatttcctttaaacagaaaaaaacaaaggtgctcatctatttcttctgaattctctctacatccttgacttaagaggaaaaccagcactcaagaaacagctttaaaagagaacagtccccattctagctaccagtcttgctttcccccatcttggcaagccccagtgaatttgccattgaaagattaccctcccctttgccctcatctgcctgagctagaggccaggctgttgttaatgttttttcagttccaaagcccctgatgggacattcttgtttctgtgctactgctttctctctcttaaattaaggtgcaaggggataaatattactataactgggatgtaaggctcagtcagtgtggctattccctcccttcgggggaaatattccatctgtctgaacggttttaggtgatcatgaggagagcggcttagtcacacagccagccacgctcatcacaaaagatttgttcagactcactgtaaagaatgacaaggcagatagctaatcctttcactgtgcctcaaagcccgccgtgcaagtcaccaaccctaccggtcctctccacgtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgcttctaaaaaaaaaaa

SEQ ID NO: 736460 - DNA, 7780 bp, Homo sapiens
gcacgaggactcacgtaaggctttttctgaatgtaattgtgaatacaaagccttgctggtcctttttatcattacccaatggatgactgtttattagctatcagcagaattccgtaggcgaaagcaagccgtgaacgatgtacattttgctttaatagcatgttagcgaacaaacttccatggacttttgtggacaaggtgctgctttttctcatgaccctgtagaattgctatcgaccacatcttctgtagcactgacctgtgtgaactcagggaagaatttgtgcatacaaatgagtggaaacagagcaggattcatgaatatgaatgagaatgtgaatcattttggagaatgccctgggcacacgggtcaactggaaatttcatttctctaagaaagtagccctaccagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtatgatattacctgacacgtaagttttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgcttccttcatttagatggactaagttattttaaactctatcttacatcagagtcctgatggtgttgggatagtcactgaccctttcacgtatgtaataagatacgtctcgttcacacactatttcatttgatctttgtaagaacccagtgtagaataggaatatttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaggagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatgaagaaagaaagaagaaagctatggttccgaaagcaggtaaccacagattttgaaaggaggcagagatggtgattaaactgtagtccttgttttttaaaatgttctttcatgttaggcaccaccacatagttaataactaccaacttctaaagagaagatccccttgatttatttatatcatgaaaatactaaaaatcaattctcaagtctaattaactattacattatcttgctaggtccttttccctaaatttttaattcagaaaattaaccagaattggccagatgcagtggttcacgcctataatcccagcactttgggagtccaaggcagatggatcacttgaggtcagtagttcaagaccagcctggccaacagaggaagaaagagtgaaaacaaaagaagaaagagggaaaccctgtctttactaaaaatacaaaaattagtcgggcgtggtggcgcacacctgtaattccagctacttgagaggctgaggcaggagaatcccttgaaactgcaggcagaggttgcagtgagccaagatttcactgctgcacctggggtgagactaccattaaggaaggaaatttcctttaaacagaaaaaaacaaaggtgctcatctatttcttctgaattctctctacatccttgacttaagaggaaaaccagcactcaagaaacagctttaaaagagaacagtccccattctagctaccagtcttgctttcccccatcttggcaagccccagtgaatttgccattgaaagattaccctcccctttgccctcatctgcctgagctagaggccaggctgttgttaatgttttttcagttccaaagcccctgatgggacattcttgtttctgtgctactgctttctctctcttaaattaaggtgcaaggggataaatattactataactgggatgtaaggctcagtcagtgtggctattccctcccttcgggggaaatattccatctgtctgaacggttttaggtgatcatgaggagagcggcttagtcacacagccagccacgctcatcacaaaagatttgttcagactcactgtaaagaatgacaaggcagatagctaatcctttcactgtgcctcaaagcccgccgtgcaagtcaccaaccctaccggtcctctccacgtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacgttatgagggatcctctagacgcctcc

SEQ ID NO: 736461 - DNA, 8566 bp, Homo sapiens
gcacgaggactcacgtaaggctttttctgaatgtaattgtgaatacaaagccttgctggtcctttttatcattacccaatggatgactgtttattagctatcagcagaattccgtaggcgaaagcaagccgtgaacgatgtacattttgctttaatagcatgttagcgaacaaacttccatggacttttgtggacaaggtgctgctttttctcatgaccctgtagaattgctatcgaccacatcttctgtagcactgacctgtgtgaactcagggaagaatttgtgcatacaaatgagtggaaacagagcaggattcatgaatatgaatgagaatgtgaatcattttggagaatgccctgggcacacgggtcaactggaaatttcatttctctaagaaagtagccctaccagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtatgatattacctgacacgtaagttttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgcttccttcatttagatggactaagttattttaaactctatcttacatcagagtcctgatggtgttgggatagtcactgaccctttcacgtatgtaataagatacgtctcgttcacacactatttcatttgatctttgtaagaacccagtgtagaataggaatatttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaggagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatgaagaaagaaagaagaaagctatggttccgaaagcaggtaaccacagattttgaaaggaggcagagatggtgattaaactgtagtccttgttttttaaaatgttctttcatgttaggcaccaccacatagttaataactaccaacttctaaagagaagatccccttgatttatttatatcatgaaaatactaaaaatcaattctcaagtctaattaactattacattatcttgctaggtccttttccctaaatttttaattcagaaaattaaccagaattggccagatgcagtggttcacgcctataatcccagcactttgggagtccaaggcagatggatcacttgaggtcagtagttcaagaccagcctggccaacagaggaagaaacctgtctttactaaaaatacaaaaattagtcgggcgtggtggcgcacacctgtaattccagctacttgagaggctgaggcaggagaatcccttgaaactgcaggcagaggttgcagtgagccaagatttcactgctgcacctggggtgagactaccattaaggaaggaaatttcctttaaacagaaaaaaacaaaggtgctcatctatttcttctgaattctctctacatccttgacttaagaggaaaaccagcactcaagaaacagctttaaaagagaacagtccccattctagctaccagtcttgctttcccccatcttggcaagccccagtgaatttgccattgaaagattaccctcccctttgccctcatctgcctgagctagaggccaggctgttgttaatgttttttcagttccaaagcccctgatgggacattcttgtttctgtgctactgctttctctctcttaaattaaggtgcaaggggataaatattactataactgggatgtaaggctcagtcagtgtggctattccctcccttcgggggaaatattccatctgtctgaacggttttaggtgatcatgaggagagcggcttagtcacacagccagccacgctcatcacaaaagatttgttcagactcactgtaaagaatgacaaggcagatagctaatcctttcactgtgcctcaaagcccgccgtgcaagtcaccaaccctaccggtcctctccacgtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgcttctaaaaaaaaaaa

SEQ ID NO: 736462 - DNA, 1642 bp, Homo sapiens
gcacgaggactcacgtaaggctttttctgaatgtaattgtgaatacaaagccttgctggtcctttttatcattacccaatggatgactgtttattagctatcagcagaattccgtaggcgaaagcaagccgtgaacgatgtacattttgctttaatagcatgttagcgaacaaacttccatggacttttgtggacaaggtgctgctttttctcatgaccctgtagaattgctatcgaccacatcttctgtagcactgacctgtgtgaactcagggaagaatttgtgcatacaaatgagtggaaacagagcaggattcatgaatatgaatgagaatgtgaatcattttggagaatgccctgggcacacgggtcaactggaaatttcatttctctaagaaagtagccctaccagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggtcgacgcggccgcgaatttagta

SEQ ID NO: 736463 - DNA, 8465 bp, Homo sapiens
caagaattggcacctgtagccatctggcatgttagcgaacaaacttccatggacttttgtggacaaggtgctgctttttctcatgaccctgtagaattgctatcgaccacatcttctgtagcactgacctgtgtgaactcagggaagaatttgtgcatacaaatgagtggaaacagagcaggattcatgaatatgaatgagaatgtgaatcattttggagaatgccctgggcacacgggtcaactggaaatttcatttctctaagaaagtagccctaccagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtatgatattacctgacacgtaagttttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgcttccttcatttagatggactaagttattttaaactctatcttacatcagagtcctgatggtgttgggatagtcactgaccctttcacgtatgtaataagatacgtctcgttcacacactatttcatttgatctttgtaagaacccagtgtagaataggaatatttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaggagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatgaagaaagaaagaagaaagctatggttccgaaagcaggtaaccacagattttgaaaggaggcagagatggtgattaaactgtagtccttgttttttaaaatgttctttcatgttaggcaccaccacatagttaataactaccaacttctaaagagaagatccccttgatttatttatatcatgaaaatactaaaaatcaattctcaagtctaattaactattacattatcttgctaggtccttttccctaaatttttaattcagaaaattaaccagaattggccagatgcagtggttcacgcctataatcccagcactttgggagtccaaggcagatggatcacttgaggtcagtagttcaagaccagcctggccaacagaggaagaaagagtgaaaacaaaagaagaaagagggaaaccctgtctttactaaaaatacaaaaattagtcgggcgtggtggcgcacacctgtaattccagctacttgagaggctgaggcaggagaatcccttgaaactgcaggcagaggttgcagtgagccaagatttcactgctgcacctggggtgagactaccattaaggaaggaaatttcctttaaacagaaaaaaacaaaggtgctcatctatttcttctgaattctctctacatccttgacttaagaggaaaaccagcactcaagaaacagctttaaaagagaacagtccccattctagctaccagtcttgctttcccccatcttggcaagccccagtgaatttgccattgaaagattaccctcccctttgccctcatctgcctgagctagaggccaggctgttgttaatgttttttcagttccaaagcccctgatgggacattcttgtttctgtgctactgctttctctctcttaaattaaggtgcaaggggataaatattactataactgggatgtaaggctcagtcagtgtggctattccctcccttcgggggaaatattccatctgtctgaacggttttaggtgatcatgaggagagcggcttagtcacacagccagccacgctcatcacaaaagatttgttcagactcactgtaaagaatgacaaggcagatagctaatcctttcactgtgcctcaaagcccgccgtgcaagtcaccaaccctaccggtcctctccacgtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgcttctaaaaaaaaaaa

SEQ ID NO: 736464 - DNA, 3218 bp, Homo sapiens
ccccagctatgtatacgtacgatgccgggtgttaatcaggccgcaggtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgcttctaaaaaaaaaaa

SEQ ID NO: 736465 - DNA, 7467 bp, Homo sapiens
  misc_feature (24)..(24): n is a, c, g, or t
tactactactaaattcgcggccgngcgacctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtatgatattacctgacacgtaagttttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgcttccttcatttagatggactaagttattttaaactctatcttacatcagagtcctgatggtgttgggatagtcactgaccctttcacgtatgtaataagatacgtctcgttcacacactatttcatttgatctttgtaagaacccagtgtagaataggaatatttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaggagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatgaagaaagaaagaagaaagctatggttccgaaagcaggtaaccacagattttgaaaggaggcagagatggtgattaaactgtagtccttgttttttaaaatgttctttcatgttaggcaccaccacatagttaataactaccaacttctaaagagaagatccccttgatttatttatatcatgaaaatactaaaaatcaattctcaagtctaattaactattacattatcttgctaggtccttttccctaaatttttaattcagaaaattaaccagaattggccagatgcagtggttcacgcctataatcccagcactttgggagtccaaggcagatggatcacttgaggtcagtagttcaagaccagcctggccaacagaggaagaaagagtgaaaacaaaagaagaaagagggaaaccctgtctttactaaaaatacaaaaattagtcgggcgtggtggcgcacacctgtaattccagctacttgagaggctgaggcaggagaatcccttgaaactgcaggcagaggttgcagtgagccaagatttcactgctgcacctggggtgagactaccattaaggaaggaaatttcctttaaacagaaaaaaacaaaggtgctcatctatttcttctgaattctctctacatccttgacttaagaggaaaaccagcactcaagaaacagctttaaaagagaacagtccccattctagctaccagtcttgctttcccccatcttggcaagccccagtgaatttgccattgaaagattaccctcccctttgccctcatctgcctgagctagaggccaggctgttgttaatgttttttcagttccaaagcccctgatgggacattcttgtttctgtgctactgctttctctctcttaaattaaggtgcaaggggataaatattactataactgggatgtaaggctcagtcagtgtggctattccctcccttcgggggaaatattccatctgtctgaacggttttaggtgatcatgaggagagcggcttagtcacacagccagccacgctcatcacaaaagatttgttcagactcactgtaaagaatgacaaggcagatagctaatcctttcactgtgcctcaaagcccgccgtgcaagtcaccaaccctaccggtcctctccacgtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgcttctaaaaaaaaaaa

SEQ ID NO: 736466 - DNA, 8320 bp, Homo sapiens
  misc_feature (24)..(24): n is a, c, g, or t
tactactactaaattcgcggccgngcgacagagcaggattcatgaatatgaatgagaatgtgaatcattttggagaatgccctgggcacacgggtcaactggaaatttcatttctctaagaaagtagccctaccagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtatgatattacctgacacgtaagttttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgcttccttcatttagatggactaagttattttaaactctatcttacatcagagtcctgatggtgttgggatagtcactgaccctttcacgtatgtaataagatacgtctcgttcacacactatttcatttgatctttgtaagaacccagtgtagaataggaatatttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaggagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatgaagaaagaaagaagaaagctatggttccgaaagcaggtaaccacagattttgaaaggaggcagagatggtgattaaactgtagtccttgttttttaaaatgttctttcatgttaggcaccaccacatagttaataactaccaacttctaaagagaagatccccttgatttatttatatcatgaaaatactaaaaatcaattctcaagtctaattaactattacattatcttgctaggtccttttccctaaatttttaattcagaaaattaaccagaattggccagatgcagtggttcacgcctataatcccagcactttgggagtccaaggcagatggatcacttgaggtcagtagttcaagaccagcctggccaacagaggaagaaagagtgaaaacaaaagaagaaagagggaaaccctgtctttactaaaaatacaaaaattagtcgggcgtggtggcgcacacctgtaattccagctacttgagaggctgaggcaggagaatcccttgaaactgcaggcagaggttgcagtgagccaagatttcactgctgcacctggggtgagactaccattaaggaaggaaatttcctttaaacagaaaaaaacaaaggtgctcatctatttcttctgaattctctctacatccttgacttaagaggaaaaccagcactcaagaaacagctttaaaagagaacagtccccattctagctaccagtcttgctttcccccatcttggcaagccccagtgaatttgccattgaaagattaccctcccctttgccctcatctgcctgagctagaggccaggctgttgttaatgttttttcagttccaaagcccctgatgggacattcttgtttctgtgctactgctttctctctcttaaattaaggtgcaaggggataaatattactataactgggatgtaaggctcagtcagtgtggctattccctcccttcgggggaaatattccatctgtctgaacggttttaggtgatcatgaggagagcggcttagtcacacagccagccacgctcatcacaaaagatttgttcagactcactgtaaagaatgacaaggcagatagctaatcctttcactgtgcctcaaagcccgccgtgcaagtcaccaaccctaccggtcctctccacgtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgcttctaaaaaaaaaaa

SEQ ID NO: 736467 - DNA, 8778 bp, Homo sapiens
ctcctggtgtcctgtcaccaggaggagaaaggacgtgttagagtagaggaaacaaacacgtcctttctcctcctggtgtcctgtcaccccccatgcagcaccactgatgcgagatgatgctctggcctggtccaggaagccctgagccatgggcagattgcccagtggccttgggcggccagagcttgtcacctgtttaaacaagttcaccatgtgtttaaatgacagggtacagtcctggaccagaggtttttctcttcagcaaagctccctggcccttgatcgttggactgttactaatagaaaaagattcaagtcatgaagtataaaatccatcccccatcccagaactttgaaacacaaggagggagagatctttgctatggagcagtcctggagcaaagccccgtggcttccacccccagatatataccccataagtagtgctgagctccagcttagctgagccaagctcagtccttatctggtgttcagccagtgcacaggtataagcagaactacagagctgaatgtagcttccctgggatctcttctcctttctaaagcatttttcacacagttctgtacctcctacggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtatgatattacctgacacgtaagttttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgcttccttcatttagatggactaagttattttaaactctatcttacatcagagtcctgatggtgttgggatagtcactgaccctttcacgtatgtaataagatacgtctcgttcacacactatttcatttgatctttgtaagaacccagtgtagaataggaatatttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaggagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatgaagaaagaaagaagaaagctatggttccgaaagcaggtaaccacagattttgaaaggaggcagagatggtgattaaactgtagtccttgttttttaaaatgttctttcatgttaggcaccaccacatagttaataactaccaacttctaaagagaagatccccttgatttatttatatcatgaaaatactaaaaatcaattctcaagtctaattaactattacattatcttgctaggtccttttccctaaatttttaattcagaaaattaaccagaattggccagatgcagtggttcacgcctataatcccagcactttgggagtccaaggcagatggatcacttgaggtcagtagttcaagaccagcctggccaacagaggaagaaagagtgaaaacaaaagaagaaagagggaaaccctgtctttactaaaaatacaaaaattagtcgggcgtggtggcgcacacctgtaattccagctacttgagaggctgaggcaggagaatcccttgaaactgcaggcagaggttgcagtgagccaagatttcactgctgcacctggggtgagactaccattaaggaaggaaatttcctttaaacagaaaaaaacaaaggtgctcatctatttcttctgaattctctctacatccttgacttaagaggaaaaccagcactcaagaaacagctttaaaagagaacagtccccattctagctaccagtcttgctttcccccatcttggcaagccccagtgaatttgccattgaaagattaccctcccctttgccctcatctgcctgagctagaggccaggctgttgttaatgttttttcagttccaaagcccctgatgggacattcttgtttctgtgctactgctttctctctcttaaattaaggtgcaaggggataaatattactataactgggatgtaaggctcagtcagtgtggctattccctcccttcgggggaaatattccatctgtctgaacggttttaggtgatcatgaggagagcggcttagtcacacagccagccacgctcatcacaaaagatttgttcagactcactgtaaagaatgacaaggcagatagctaatcctttcactgtgcctcaaagcccgccgtgcaagtcaccaaccctaccggtcctctccacgtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgcttctaaaaaaaaaaa

SEQ ID NO: 736468 - DNA, 2780 bp, Homo sapiens
  misc_feature (986)..(986): n is a, c, g, or t
aagatagcaaatacacccccttcctcttgtaacccggtcaggcctagggttcctccctgagttccagaataggccacccagttggggcggacccttaaggcattctgggcccacgcctgcctataaaccctcatagtgtgacctttgacccctggtgtgatcttgggcccgggctgggaccagcccctagtgtgggttgtgggggcggccatggagctgggcagctgcttcaagacctatgaggacttcaaggagtgcttcagcgcctacaaaagggagaacaggtgctccttcattctcagggactgcgtctccgtccgcttccacaacctcaaccatggcacctccatccgcgaagacatcctgtatgtgcaggtgaaatttgtctgcattcggacccaatcaaacaggaagagaacgcgggaggcagacatgtgcccagcgtacttgctcctaaggtacaacgagagactagatagactatttatcagtgaactaaacacacagcacatacatggtgactctaaagtggctagtcctggaggagacaccactggcaaatctcaaaagacaatgtgcctgcagagactccagcctgtgcagcccacaaccaaaaaagaccttgacactgccgagaagtccctggttgagccatcgttttgcctagataaggtacaagtgtcctcaaagccagagcaggaaggcatcactccttctgacctggccaagatagcaaaagtgatgaagaactttcttaaggtagatgagggttccatggcttccttcagtgtgggtgacagccagcacctggaccggctcagcttccagagcagtaagatgaccgacctgttcatccgcttcccagagaatctcttgctacaccgggtggagaacacccagggccacatcctctatgctttcttggtggagaacaaggaacgagaaagtcgagtggtgcactttgctgtgctcaaggcggagacagncacctctgtggccaagatgctgagcatcttcacagagttcaactccgattggcccaaggtcaaggtggtctttgtggacccttcattccattaccgggctatcctgcaggagatctttcctgctgcccgcatcctcctttccatctaccacacaacccgactcttggagaagaagttgcatcgtagttcagcaaatccatcctttaaaaggctcatgaaggaagccctgcgggaggccgtgtttgtcacttctgaagccagcctgaaaaatctctgccagatgtcccaggccgtactggatgaggatctcttcaacttcctgcaggcccactggttcacctgtgaactgctgtggtacatgcatgttaggaagggcctgcttgcgtgtaacacctacatggacagcctagacattgtcaccagcaaggtgtcaagcctctttcgggaacagcagtcgctgctggactgcatcctctgctttgtggattacatagacttctttaataccaaaggcttgaagaacttgcccacacctcctcccaaattaaagagagctcggccggcaagcatgccactgaagtccaagaaggcttttggaatctgtggagagagccttaccagcctccctgcagaagagaccaagccagacgcacagcaggtacaggtacagcagcagtcacaagtgccgccctcgcaggttggcatgctggacaccttgcaccagagtggctctgaactagcctacaagctgtgccacaatgagtgggaggtggtacagaactccacccacctggtggacatggctggctcttcagtggacgttcagctgctagaggactctcaccaggttagcaaagatggctgtagctgcagctgttcctttcaacaatggtaccacctgccatgccgacacattttggctctgctgcacaccagccagcagccggttggtgaagccatggtgtgccgccggtggcagaagaagtaccagtacctccttgggcccaatggggagctccaggatcgtggtatggtcccaaacacaggccagcctgagaagcaaggacggaacgacatgattcaggacctaagcagggagttagcaaacctgctcatgcagaccgaggggccagagctggaggaacgctactccaccctgcgcaagattgtggatatctgggctggcccctcccagccatctgagctctttcagcagccaggagactttaaggacgtgggccgcctccctttcctctggggaaagcaagaagaaggggagggattccctcctgctacagctgtgatgcattattgaagcactttagctgaagcattggaccacaaacacttctccttggaagtgtgagagtttaaagtgggcaggacatactagggtttagcattttagccaatgtcttcctaggtggggctaggaatattgttacagtagagaggaagggaactccactgtgtgacagtcctttcaatctgccccttttcagccctacttttggcattccttgggagcctcagttgttgttcaaggccaaagttatctccgtgctgcaaggtcaccctcttcctcccccagcccctgagatcagatcttatttgctctgcaaagatgaatccctgcctcaggttagggtgagacaaaatcggtctggtaaaagggcctgttttcagggacaaagggaatgaggatgatctttggctgttgctgctctttatgaagaatcttatttgtaactttttattcatattaaagttgtttttaataaaattaaacaaggg

SEQ ID NO: 736469 - DNA, 681 bp, Homo sapiens
aagatagcaaatacacccccttcctcttgtaacccggtcaggcctagggttcctccctgagttccagaataggccacccagttggggcggacccttaaggcattctgggcccacgcctgcctataaaccctcatagtgtgacctttgacccctggtgtgatcttgggcccgggctgggaccagcccctagtgtgggttgtgggggcggccatggagctgggcagctgcttcaagacctatgaggacttcaaggagtgcttcagcgcctacaaaagggagaacaggtgctccttcattctcagggactgcgtctccgtccgcttccacaacctcaaccatggcacctccatccgcgaagacatcctgtaagggcgggcggggcggggcgggccaagagggtggggaggaggctggacctccggagggctgcctggaggaggaggggtgcataggcacgcattgggctgcgtggccattcattcaacaggcactcattgagcacctgctgtgtgccttgtgaagagagctaagcctccacggccattggtttttgaccacccactccactttcactccattcacaggcttttctggaatttataactgcagtttctcccattgttttgagcagctgcagcaacccaaatacaaagtatggctttcataaacggataaaaacac

SEQ ID NO: 736470 - DNA, 554 bp, Homo sapiens
cgctgtgatcgctctagagatccccctgtatcctgggagggattccctcctgctacagctgtgatgcattattgaagcactttagctgaagcattggaccacaaacacttctccttggaagtgtgagagtttaaagtgggcaggacatactagggtttagcattttagccaatgtcttcctaggtggggctaggaatattgttacagtagagaggaagggaactccactgtgtgacagtcctttcaatctgccccttttcagccctacttttggcattccttgggagcctcagttgttgttcaaggccaaagttatctccgtgctgcaaggtcaccctcttcctcccccagcccctgagatcagatcttatttgctctgcaaagatgaatccctgcctcaggttagggtgagacaaaatcggtctggtaaaagggcctgttttcagggacaaagggaatgaggatgatctttggctgttgctgctctttatgaagaatcttatttgtaactttttattcatattaaagttgtttttaataaaattaaacaaggg

SEQ ID NO: 736471 - DNA, 1650 bp, Homo sapiens
ggcttaggttatcctcccacctcagcctcccaagttgctgctgggactacaggtgtacgccatcacacctgtctaattttttgtaattttaattgagacaggggttcgccatgttgtccaggctgatcttgaactcctgggttcgagcgatctgcccgccttggcctcccaaagtgctgggattacaggcatgaaccacctaacctggctaggatcgcactttgagacttttctcttttttcttttttttcaaaggaagcaaatcagaaatgagatggagtatcatgattagcatctcagagctaatttaaggaaaattgggagagggtgtttgatcatgtcagatctaatctctttcagtaaagtctctttcctcccccataccttcattgtctagagccaagagttggttggatataatgttggctctttttaatccaagttgccatcgctaaaagtagcatcatgacacctgtctggtgctttcaagtctcaagtaaatttctggcagtttgaaaatgatgttaaaaagcacttgggttttaaaaaaaggcacttgaaggagatggtttattctcctcctgtacacacatatgtacataccttgtcaaatgttacttctcttccttattctccctgtgctagaaacgttctccaggtaattgctttttgaaaccgaggttgagcattgcccagcctaaatatgaatatctctaccagtagggaatgaatacttcttgatagccagttttaaaagtaagttgttaatagaaaatactgagcatggcataattctttgtctagagccaggaggacataactctgtgttattctagttgaaacttttcctctaacctaacagtgatcaacagccttctatcctagtgttcagcttacagtttatctgtcttgtgtgcaaagatatcccatataaggtcatccgatcacttgtaaatgtttgcgaaagtattgtgtagaatcctagtcttagatgtgatttatagtaaattaggcattagaccagggaaacaaatctgtggatgttctgggtactagcttgatgcctctctagatgccatccctcttctctagcgcataaatccacagtgtgcttttatatatttatttttccaaatggagaaccccactgtgagaaagggaccagagaatatctttttctctggcaagattccatctgtggattattttattagacatgccttctgaaagattaggggtggaggatcaaaagaaatattctttatctgaaggctctttgatcttcagggttgatagaatctgttaaagtgttagataatacagtacctaatgatttctttttaggcttaaatagcctcactgaatgagattatttacttaactgtgattgccctttctgtttcggaattgaccttgctaatttttgaatcaggagcactgaaacagatctctaaattttgaaggtctggctctaggaagcacaagtgtggaagattttaggtcttaggttttaatgttcagagcgtttcttccaattcaaaacgtaatcactggaaaataaacttctaaatgaaaatgtgctttggtcagctgcctctgaattatcattgtgcaacattacttaaataaatttgtgtttgaaagaccttg

SEQ ID NO: 736472 - DNA, 1153 bp, Homo sapiens
ttcctttaaagtctcaaatatctatcagtgtagaagagtgggaagacaccaaagactccaaagaacaagggcaccaccgcagcaaccaccgcaactcaacatccagtgatcagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatgatgaaatgaatgatcatcaaagtaccctctcctacatcctgattaacccatctccagataccagaatagagctgaatgatgttgtatacttaattcgaccagatccactggcctaccttccaaacagtgagcccagtcgaagaaacagcatctgcaatgtcactggtcaagattctcgggaggaaactcaactttgataaaaataaaatgagaaacttttttcctacaaagaccttgcttgaaaccacaaaagttttgctggcacgaaagaaactagatggaaatatatgtaattctctcatatttaaaaacgtaatctcttctcttagaagtatagatcattttgaaacttaatgtactacttactggtactctccctattaatatttgaaggacctcaatggaataaatttgaaaagctaaattaaaatacaaaaatttaaatctgacatttaattgttttataataatccaaactctatgaaagcaattttaaaaattattaaggttttatgaagttgacaaaatctaactatatttggtgcatcacaatggacacagaatgctgctgctcctcttaaaaattaaatgtgtcatattatattctttaaacttactgttttacaaaattgagctcatcgtaaatgtctagtcttctcacatagagattaaccaacaaacttgtgtggctgacttttgtgtaagaatcatagtttgctttagaatacaaatctttaagtcattttaacttttttttctgccttacgatataaaaatatttatcttagaatttgagatgttcatagcatgttttattacattgaagaaactaaaacataaa

SEQ ID NO: 736473 - DNA, 414 bp, Homo sapiens; identical to SEQ ID NO: 273758

SEQ ID NO: 736474 - DNA, 919 bp, Homo sapiens
  misc_feature (913)..(913): n is a, c, g, or t
gtatatgtatgtgtagaaagccttctcacctttctgagaatgggtgaggataaatatgacaaaatactgcagaagtaacctcagtgaacactgaaactatgtggaaattgctttgactggaaaatgaagggagtttgtattgtggatcattaaaagataagatggggtagaaaaaataggatcagatcatgaagcacatgaaaggttaagtacatgattttagttaactttgatccaaagagtgtggaagtgctgctacttgtggtttctgagtgaagggagatataataaatgtgataattttggaaaattaatttagttgtagtatataaatgtgattgaaggtaaatggagcttggagatagaaaaaccaattaggagtctgttgtagtaattcataagattgaaagccttgattaaagtcaatagagagataaacttggagaatactttaaagggagattcttttttaaaaccagcccccaccgttttataattttacaagttgaagaagaattaagatgtggttgcaaaattttaggaagcgaaattaaataaatggtggtggtagtcatttaagtggcaaggttacaaaagggagctattttgtgagaaagaataatgtttatgttcttttacgttgaatgtaactggtggttggacatccagtagacagttttttgtttattggagaatttgtttacagtcatttctctgtgggggggaaatcctcaggtaacactgagtttcttcattattattagttaggaaattcagactacgtaacatattacctaatccagaagtaaaattgtttaagcatttctaagaaattagaaattactgtaaaataggaccaataaatgtataaaagtccacctatttccactaagttttaccatcttaactgccnggcatt

SEQ ID NO: 736475 - DNA, 1084 bp, Homo sapiens
attcactcagaaaaaaaaataaccaacaaagagttatatgttaaacagcaaaaagaaaataatacagactagagccaaatatttattgactgagtaaggaagatgatttagaccattatttacatcatttcagaaaaacctacatcacaaaggagaggtaacacgaccaaatcattaacagggaagcgaaagcaactgcaccaggaacctggagtcttatcaggagaataaatatgtatgtgaaatctcatactggattttcctgttcctttcctataaaagacgtggtttccgatgttgacctggggcaaaatcaaagctcacctgggctaagtcagcacacagttcctaatccttaggtaaaaagatacacttgtgaacagtaacgctcagtcaagctcacagcctctccacatcatcagggagttaacgtgcaatttataagcaggctaggatgtttgaagaatcccattccattcactaaaaacccagggatctcattcccaccctaagtgcagggcaagccctcggtattgtttcagttaacattcctgggcctcagtttcctcgtctgaaaaaggaagggactttggaatgggaaatctctacgatccctctcatgattcagataggctatttttcttttccaccaatagaggaagagactttctgacagccaacatttccattcctactattttggaacaaccagaacactgaaaatttggtacgaaaagcttttcttacgataaagagataacatttccttaagaacagttgctgaaacttcagctggggaacttatcaaataaagaaaccacctcatttcagactatgggctgaatccaataaagtcaaacccaacgcctcccaggaatttagaattacacagttgttgatcaagtggagagaaaagaatgtgaatttgttttttcaagattctctaacaccatatgaactgtggctgccttttctttaaatcatataatggaaaaaaacaaacttctagaaaaagatatgtatcatctcctccaagtggtgactggtccctgctcaatgtgttgtggtttaccttgccttgaac

SEQ ID NO: 736476 - DNA, 1173 bp, Homo sapiens
gctccccaggttgcactcgtaattctcactatccatggccttgttgataactgaggatctgatactggcttcctgatgtttcttttttttttggagacagagtctcgatctgttgcccaggctggagtgcaatggcaagatcaatctcagctcagtgcaaccttcacctcccgggttcaagcaatcctcctgcctcagactcccaagttgctgggattacagaaaaacctacatcacaaaggagaggtaacacgaccaaatcattaacagggaagcgaaagcaactgcaccaggaacctggagtcttatcaggagaataaatatgtatgtgaaatctcatactggattttcctgttcctttcctataaaagacgtggtttccgatgttgacctggggcaaaatcaaagctcacctgggctaagtcagcacacagttcctaatccttaggtaaaaagatacacttgtgaacagtaacgctcagtcaagctcacagcctctccacatcatcagggagttaacgtgcaatttataagcaggctaggatgtttgaagaatcccattccattcactaaaaacccagggatctcattcccaccctaagtgcagggcaagccctcggtattgtttcagttaacattcctgggcctcagtttcctcgtctgaaaaaggaagggactttggaatgggaaatctctacgatccctctcatgattcagataggctatttttcttttccaccaatagaggaagagactttctgacagccaacatttccattcctactattttggaacaaccagaacactgaaaatttggtacgaaaagcttttcttacgataaagagataacatttccttaagaacagttgctgaaacttcagctggggaacttatcaaataaagaaaccacctcatttcagactatgggctgaatccaataaagtcaaacccaacgcctcccaggaatttagaattacacagttgttgatcaagtggagagaaaagaatgtgaatttgttttttcaagattctctaacaccatatgaactgtggctgccttttctttaaatcatataatggaaaaaaacaaacttctagaaaaagatatgtatcatctcctccaagtggtgactggtccctgctcaatgtgttgtggtttaccttgccttgaac

SEQ ID NO: 736477 - DNA, 2666 bp, Homo sapiens
acttcggagagagaatgtagaatggaggaggtgaggaatttaactaatagagatgctttttctaacaggcagaaattagagaaatggatcaaaagatttaaacattgattacatataaacgagtttcctttttttctacatagcacacaggtgctcaacatttaatgaataatataacagatactgtcttaaaagtttaaaaacaggatttgtacttaatcctaaattcctcttatcacacaccagaaaataatttggattttatttacaaactacatccaaatactcttaaggaaagagtgtcatttagcttggagtagggactgactggggtctaagtgttggaaattaaattctgccattcagtccaacctcaaaggtgttccaggcaaggagttttgcaaggactagaaaccctttcacacttgaagtgcaggtgttggctgaaagaatagagggacatttcacaaacacagaacacggctcccctacaggaaagggatggagacagctacctttgctcttgctctcacattctctgtcctcatggactttcttctctgtttccctctgcctatctatctgcctggttctcttgcttctcctggccaaccagctttctcattagtgcatatgtagctgaaaaatccacccctcaagaacccactccacacaacctttccttttcagtacccaccacgctctgactagcatctctgtgatgcctaaggcaaatttttgaggatctgattggtttagttcatctgcctatgggtgagccaccctggggtcaggtgcctgtccaatcacctgttaccaaggaggcagggccgtgtcatttaagcatggccccatggactgaccctttcagcagggacttttattgggggctggtacccagaagaaggagcatgagtgggcaagaccttcaaaaagaacctactacacactggaactgactagtactcctgggatgccatgccacgcagcagccagcactcggagagcagtcccctggatactaccacacagagaaaaggggcatcttcacttgcacatcaggtgagggtgcacacacttgaaactctgctagactggccagagctgccccagccacttctcaccccaccaccagttattgatacagccgctgggtctaggaagcgatttctgaacaaggcccagttagcacaatgtcttgctcagcagacaataaatacttgtaaattgaattgcatgatcttagctcaggtgctactaatgtggctcacggccacacacttgcatggataagaaaaccaatgagcccctcaacagagtcttttgaaacaaaattggtttcaagtgaaacttacattattttttggctgtgaccttctgaatataataacttagtgtcctgagaattgaaaggcctcttgatttcttaggtgaactgttacagaatcctagcctgtggtaaatgctaaaatgtaaggtgtttctgagaaggaatatttaggaaatataattgtgccacacacacattactttagaagatatgcagttgctctgattctgcaggtttaaaaaaaatgggaagtttgtgatatggcagaatctgtctccattggtcaaaccatacttcagtgagagccattataagtgaaatctaaaaattgatcgttttcattctctgactttggtcagacttttgcaaattatggagagaggccatcaacatattttacataaattactgtggccccatcttatttctcctcatttcttccttatgtttaaacacgcccccatctcacacacaaactgagaaaagatttgtatcaaacagaatcagaggcatatgaatggactggaaattgtgaaaaaggtataaatatcctagaccttgatcaactcactttaaactggtctctgattcctcatctgtcaaatgagtataagaccctctgtacttcccatggtgattttgaggagcacatgcataatgtatctgaaaatggcttgacaagcacttgaagccattcttactaaattattagttttgtaattcggttttatccaggaaaatattttagctcctcctatctgctgaattaatttatacagtcacatgttccatgacaccatgttttgccaaggaaaaataaagaaattcctaaatttgaaattgcccacaagatctagcctcatctggagttgctgttattgtccttgttgtctatgatttggaggatatgtaagtacttgtacatgtgctttaactctgggtgaaaaaccccaaccggtgagtctttaaaaccatattagacacattgggcaaagtactgagcagaagctttgaatgtagctgttgttattttaatgcttcgctttctaatgaactttgtacgtccttagcctctgccgggaacagagtgttcatatgctgttagaattttttattgtaaaataaaatgacaaaggctttcataccccaaaaaaaaaaaaaaaaaacaaaaaaaagggggggcccaaatatcccggggcgccttgccccctttttaaagggccccaaggggcatataacgggcgggggcgtacaccggcggaaactcccggttctgacccctctggggtatgacccccaagcggcatacttgttggccctcccggtctcgtaaacc

SEQ ID NO: 736478 - DNA, 904 bp, Homo sapiens
ttcagagccaggcctggctctgaacttaggatctcacacacaaactgagaaaagatttgtatcaaacagaatcagaggcatatgaatggactggaaattgtgaaaaaggtataaatatcctagaccttgatcaactcactttaaactggtctctgattcctcatctgtcaaatgagtataagaccctctgtacttcccatggtgattttgaggagcacatgcataatgtatctgaaaatggcttgacaagcacttgaagccattcttactaaattattagttttgtaattcggttttatccaggaaaatattttagctcctcctatctgctgaattaatttatacagtcacatgttccatgacaccatgttttgccaaggaaaaataaagaaattcctaaatttgaaattgcccacaagatctagcctcatctggagttgctgttattgtccttgttgtctatgatttggaggatatgtaagtacttgtacatgtgctttaactctgggtgaaaaaccccaaccggtgagtctttaaaaccatattagacacattgggcaaagtactgagcagaagctttgaatgtagctgttgttattttaatgcttcgctttctaatgaactttgtacgtccttagcctctgccgggaacagagtgttcatatgctgttagaattttttattgtaaaataaaatgacaaaggctttcataccccaaaaaaaaaaaaaaaaaacaaaaaaaagggggggcccaaatatcccggggcgccttgccccctttttaaagggccccaaggggcatataacgggcgggggcgtacaccggcggaaactcccggttctgacccctctggggtatgacccccaagcggcatacttgttggccctcccggtctcgtaaacc

SEQ ID NO: 736479 - DNA, 834 bp, Homo sapiens
ttgcctgctgagtagacataaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccagctgctcagctgatttcacagaggggtgacaagggaggacaacagacacttcaaaaggcaagaagaggatggcaggagctcttttgccatggctaccaggccgatctccgagcggaaccaggatgccactgtgtacgtggggggcctgaatgagaagttgcagcaattgaagccatgaatgggcagtacctctgtaaccaccctatcaccgtatcttatgccttcgagaaggactccaagggtgagcgccatggcttagcagctggacgacttctggcagctcagaacccgctctcccagcctgaccgccctcatcagctgtttgcagatgcacctccttcaccctctgcccccaatcctgtggtatcatcattggggtctgggcttcctccaccaggcatgcctcctcctggctccttcccacccccagtgctg

SEQ ID NO: 736480 - DNA, 733 bp, Homo sapiens
ttgcctgctgagtagacataaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccaggtaaatcatattcaaggcctgagttaagttccaataacttcagtaattttctcaaagaaaactgaaaaggatggtaggagaattgttttaaatgtgccgagggaatgtgtgatactacaaaagagaacagtttgggaactttaaaaaacctgaaataattacaatgttaaaggacatttacttcaaatgtccccaaaactcttgtgaaggacttctgtcttaactctaccataattgccattccatcataatcttcccaaaattacatgaagccgtttttggcatttcccgccacagggaaacatacagataacttctttcttaggcgtagaa

SEQ ID NO: 736481 - DNA, 455 bp, Homo sapiens
atgtaggggccaacattttcaatgggaacctggaccctgagattgatgagaagttgctttatgatactttcagcgcctttggggtcatcttacaaacccccaagattatgtgggaccctgacacaggcaactccaaaggttatgcctttattaattttgcttcatttgatgcttcagttgcagcaattgaagccatgaatgggcagtacctctgtaaccaccctatcaccgtatcttatgccttcgagaaggactccaagggtgagcgccatggcttagcagctggacgacttctggcagctcagaacccgctctcccagcctgaccgccctcatcagctgtttgcagatgcacctccttcaccctctgcccccaatcctgtggtatcatcattggggtctgggcttcctccaccaggcatgcctcctcctggctccttcccacccccagtgctg

SEQ ID NO: 736482 - DNA, 353 bp, Homo sapiens; identical to SEQ ID NO: 461151

SEQ ID NO: 736483 - DNA, 1373 bp, Homo sapiens
ttgcctgctgagtagacataaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccaggtcaacagaagaggtgaatccatttaccttcataaccgagccaactgggtgaccgtaggcatctgtttttccagctccacccacaagatccccaatgtgatgctactggcccatctgacacctggtgcccaaaaagatacagaaaccctgtttaaaagtctcctgacatctcctcctgcagagaaactagtgctcaccaggtttctccctctgcagtttgtgactctttctgtgcatgatgcggagaacatgagcctgaaagtaaagctggtgagtggtcgagcctactacttacagctctgcacctctgcatataaacaggacaccttgttttctcaatgggtggccctcatctccctcttgaatcaggagaaagccaaagtttccaaagtgtcggaggtttcaagtctctcaggaattacgaatagcacagacatcacaggctccatggatgtgacggatgtcaccacgttcacagccatcctgaccccgtacatgtatgcaggtacaggccctgaacatgtcagggacagcatagatttcccagaattcacagacatcaccgacatcacagatgtcacagatcttccagaaaatgaggtcccagaggtcccggatgtaagaattgtcacagaagtcatagaagtcagagaagccacggaagtcacagacagctctgatattacaaactgctcgggagtcacagtggtgtttgaaaacaatgacttaatcagggccaagcaagaggagaaggagcttgagaactgaatcaaacacttcaggcttgtatagtttttcagtttttcccctgattagcatttctttccccattttcactctcctctaaatcacctgttccccttccatacacttttactctcacttaacaccctgtaccccaagaaaagcaaagactggctgaatcttaatacctcattttattaaatgtaattggagtacaaattaaaaatga

SEQ ID NO: 736484 - DNA, 1299 bp, Homo sapiens
ttgcctgctgagtagacataaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccagctccacccacaagatccccaatgtgatgctactggcccatctgacacctggtgcccaaaaagatacagaaaccctgtttaaaagtctcctgacatctcctcctgcagagaaactagtgctcaccaggtttctccctctgcagtttgtgactctttctgtgcatgatgcggagaacatgagcctgaaagtaaagctggtgagtggtcgagcctactacttacagctctgcacctctgcatataaacaggacaccttgttttctcaatgggtggccctcatctccctcttgaatcaggagaaagccaaagtttccaaagtgtcggaggtttcaagtctctcaggaattacgaatagcacagacatcacaggctccatggatgtgacggatgtcaccacgttcacagccatcctgaccccgtacatgtatgcaggtacaggccctgaacatgtcagggacagcatagatttcccagaattcacagacatcaccgacatcacagatgtcacagatcttccagaaaatgaggtcccagaggtcccggatgtaagaattgtcacagaagtcatagaagtcagagaagccacggaagtcacagacagctctgatattacaaactgctcgggagtcacagtggtgtttgaaaacaatgacttaatcagggccaagcaagaggagaaggagcttgagaactgaatcaaacacttcaggcttgtatagtttttcagtttttcccctgattagcatttctttccccattttcactctcctctaaatcacctgttccccttccatacacttttactctcacttaacaccctgtaccccaagaaaagcaaagactggctgaatcttaatacctcattttattaaatgtaattggagtacaaattaaaaatga

SEQ ID NO: 736485 - DNA, 618 bp, Homo sapiens
  misc_feature (370)..(370): n is a, c, g, or t
  misc_feature (600)..(600): n is a, c, g, or t
  misc_feature (611)..(611): n is a, c, g, or t
ggttcctcggatatggcgagggcaagcactcccatattataacaacctgtgcagtcagtgagtccagagcagaggccttgtctcctcctttgctcaccttcactcactgccctggactgtcaggccccagttctcatccccatgtgtgatgaagccatgcagtcccagagagggagccatcagcgcttggtagtctcatgctttagtgtcagagttgcaccttacctttgtatccaagaaatgcatgcagctcaactttcccttaaaaggcttctaggaaaaaactaccccagcattttttttcccccagaagaatatattagcttaataataaaaggtatagtaacaaactttccatttaaaatagtgncctaagccacaaatttacctttcctgcccgtatgtgcaaaattttcattgaaatgaaaaaatacacactaagaatcaatccagtgtgatgttggaaaagagagaaggttaccattttcaaatatgacaggtgtttctggaggtcacaaggcaaatggtactgggttgttggaatccctgagctaaataatggctgtgaaaatgccagatgagattggttatctcagcagngcctgggctgnaccccta

SEQ ID NO: 736486 - DNA, 1804 bp, Homo sapiens
tgtagagatgggtgtctcactatgttgcccaggctggtctcaaactcctggcctttagtgatcctctcaccttggcctcccaaagtgttgggattacaggcgtgagccactgcactcagccccgttactttccagcatttaatgttatttgacactttagttgacactctgattcttagtcttttatagattgcctatttggttgtgctctcttgctctctttccccagagactttaccaaggtatgtctcagtccatccccaattcttgcttaacactgtttagagaaaactccctctaaccgcacttttcctctactctcacacaacaatcatcaacacagaagacttctgtgatcaaatatgggttaattccccatacacccatcagcagacaccagctgcatgtcctctaattcaattccaacactatttacctagagatggtgtcagatcccacaggctgaggggtcagtccccaagactgcccctccacaccagtcgccaagtccgggccttcagaacttctgaccaaccagcttcaaagttcccatgaccccttctttgggttcaataaatttgcagaagcagttcatacaactcagggaaacacttagttcaccagtttattgctctatactggaaaaaatacagacgaagaaacgctagggcaaggtatgggggaagaggcttgaagcttccatgccctacctgggcacaccactctcccggaacctccacatgttcagctattgggaagctctctgaaccctgtcctcttggaattttgagtcttaagacccacaatcagaaaggtgggagaatattagagtggaaggagggcagaacaccagaggcctacctgaggcctaacacatccaacattataacaagactgtgtaagggctgtgggagttatgagccaaagaaccctggatgaaaaacctacatatatatataacaccacacactcagtagatgcttttgatatgaactatgtatttcactcagaagaattatctgctctcaataatgcaattatcatctacctctctcctttttactttctatagattccccattatatggatattagttacctggaatctgtcatactacttaactcctcactctagctctgtctgctgaagattgtaaaataattccacagcttattcttccttttaactatcttgtttcagccctttccattttaaaaattcagttcttccactaagatttttattttaaccattagaattcttgtttcctgggcctttatttcacagctgtgatagattctgaagcaggctccatgatccctacctcctggtagttgtcatttttaatacccttccctaagagtgggaaggacctgtgtcttgctctcaccctacagaatacagcaaagatgacaaagtgttgcctgtgtgattacattacagaagatagtaacatctgtgctacttggaaaggcgtctctcccctgccggctttgaggaagcaagcagccacactggaatgcctacatggcaaggaactgagggcaacctccagccaacagatggcaagaactgaggccctctgtccagccatctgtaagaaactgaatgttgcccaaccaccatgtgagctgagaagtggatccttccccaacaagcctcagatgagaccacagtcctgaccaacaccttcattgcagccctgtgggtccctgaagcagaggacccagctaagcctgaaagaaactacaaggtcattaatgtgtgttgtttaaagtcactaagtttgtggtgatattgtta

SEQ ID NO: 736487 - DNA, 716 bp, Homo sapiens
  misc_feature (654)..(654): n is a, c, g, or t
  misc_feature (660)..(660): n is a, c, g, or t
ttttttttttgctcaacagtcctttaaggtatgtgtccttaaggttaacttgctacataatatctgtctatgaaaaggttgtgaaccgtgaaccaaaggactttcatgattagtcatatgacacctgaggggacagtaccaggtacccaggtaccaacctggttgaactccaaattattttcaccaaaaaggatgaaacccattttcaaattagtgatatctgactcaagacattaatgtatgtgaaagaaataaacacaaaacttggcttttctaggctcaaagacttctagaagaaacgacttaaaaaatgccactaagagaggagcaagcttgagataaattgttaataattattgttgtccagtggggattcagaaataccaatcccactccttcgtgagtgttttccttacggtctatttactctggccacaccctgctgctagacaaatttcactttattggattggaaatacaattagcatagatttttttcccattaagtaaaatattataaagccatgcttataaatatctacatcactcaggcttgcaaatagacaagacaaaaacttttcttagccttatttgctaaattgaacctgatagcaaaatttctaatgtaaatcaaatgatggatgtgctgacagntaatgncacaaagtagtcattctacaagaatacatacataactactaaaatttaaaatggcc

SEQ ID NO: 736488 - DNA, 693 bp, Homo sapiens
  misc_feature (2)..(2): n is a, c, g, or t
  misc_feature (4)..(4): n is a, c, g, or t
  misc_feature (38)..(38): n is a, c, g, or t
gncntcgggcaaattactctctgtgccttatatgtaanctggggacaataatggtatctagctcataggaggattatgttataaagattaaataagttagtatttataaagcacatagaatagtgcctgacacatggtaagaactttacaaaaagtgtttgttgttgttgctgttatttttacatgccaaggcacacatattgactcaaacttagatatttaaatcaaacttcagaactcagctttaaagcagttccataccatatggtaataaattcatctgcccgttatgtggttatcagagttagttagatcactgcagatttcttctgagaaccaggtaaagaggttaagaaagaggagctatgtaagaaggaaaatgttgtggacagccagaagaaatgtcttataactggtattgtaagtaagaaattttccagccaaactttttcaaaaaaatgatactgaattacttgataaatcatgttctggggtttctctaacttctccaggtggattggagtaggtgtgtgtctatacaccaccagtatcaagtgctttcagctttcctccaagatgtagaaacatcaaacaagtgcatcaaaacttttcaatctatttttaaaaatctagtcatgtgagattatgaagtgtgaactctcattcatttaaagtaattaccaatttttacat

SEQ ID NO: 736489 - DNA, 702 bp, Homo sapiens
  misc_feature (45)..(45): n is a, c, g, or t
  misc_feature (693)..(694): n is a, c, g, or t
  misc_feature (696)..(696): n is a, c, g, or t
  misc_feature (698)..(701): n is a, c, g, or t
tgagacagagtcttgctctgtcgcccacgctggagtgcagtagcnaaatctcagctcactgcaagctccgcctcccgggtttacaccattctcctgcctcagccttgggaggttgagactgcaatgagctgtgattgggccactgcactctagtatgggcggcagagtgagtccctatctcaaaaaataagtaaataataaagttttccaggtgattctaaatgggcagccatatttgaaaattcccattctagactgctaagttgaactgcctaaacaaaagatctaaagggagaaaaaggccaggcatggtagctcacgcctgtaatcctagcactttaggaggctgaggcacacagatcacttgaagtcaggagttcgaaaccagcctggctgacatggtgaaaccccatctctactaaaaatacaaaataattagctgggcgtggtggcgtgcacctgtaatcccagctacttgggaggctgaagcaggagaattgcttgaaccctgcaggaggaggttgcagcgagctgaggtcacaccactgtactccagcctgggcaatagagcgagactccatctcaaaaataaataaatacataaataaaataaaatgaaaacaaaaggaaaaaagtggtcttggtagagattgctagcttagcacatcatcttcttttactctatcctaaacnntngnnnng

SEQ ID NO: 736490 - DNA, 813 bp, Homo sapiens; identical to SEQ ID NO: 74646

SEQ ID NO: 736491 - DNA, 640 bp, Homo sapiens
tcaaatctccaaaaaaaaaagtttatttataaaatactgacagtttgacaggacacgggacttcttgtggtatatatttcaaatcaatttctttcttacctttcatttaaaaaataaacctgctaacacgctatatgacatagagatatatatttttttcttacagacagacacctgccataatgaatactctccccataattttttgttatatcttttaaatcaaaaaataaagatttgtgttgatttttgtttctggagtctagatggatggagaaaggtaacacgtttaaatgcttttggttattctgatggaaacaaagagaaggggggtggtcccgagggggcacctgtgctcaggtggtggtcaggattgccatgtgcgcatgcccatgggtgtccctggatagggccatacagaggcactggggagcgggtggcggctgctcagatggtctcccctttaccttcctgcccaccagcccctcacccagggtaggcaccttcagatgtgcactctgggaagctgagggaagcccctgcccagccagagtggcactgtggtgaggctctggcacctttagaagcactgcccagggaggcgtgggcagcaacagaaggccttgaggcagcgtgcacc

SEQ ID NO: 736492 - DNA, 1971 bp, Homo sapiens
ttttttttctttttttaaacaaataccattccttgtactttgtccctctgggaaattcctattcatccaacaagtctcattcaaatgctactttttacaatgaagctgccagatagttgtaggtacagtcaagcaccacataatgatgttttgatcaataacgaatgaacctgcatatacaacagtggtcccataagactatacaaccatatactctgtaactaacttttctatgtttaaatatgtatagatacatgaatatcattgtgttacaatttcctacagtattcagtacactaacatgctatacaggctcatagcctagatgtgtagtgggctataccatctaggtctgtgtaagtactctctatgatgttcacacatgaagaaattgcctaagggcacgtttctcagaactcaactctgttatgtgatgcatgacagtatttttcctgtgcctctgctgttcttgacacactccaccatcatccttttgtaatcctctgtttacccatctgtcttttaaagtataggcttattgatggcaagaatctggaatcattccttgtaattctagtcccagcacagtgcactcaagaaatatttattaaataatataggtaaaaatctaattacagtgattgtaacaacattctgcctaagttattgcacatctaccaaatacagtatggtacaggagaaaaaaacaagttttaatgtcagataaacataaagtaatccccccttatctgtagggaatatattctaagaccctaactttacttaataatggctctgacgtataagagtagtgatgctggtaatttgaatacgccaaagggaagctgcaaagtgcttcctttaagtgaaaaggtgaatgttcttgatttaataagaaaacaaaagaaatcatacgctgaggttgctaaagcatacaataagaagggaggatagtctatccatgaaattgtgaagaagaaaaaataaattcatgttagttttgctgtcacacctcaaactgcagaagttatgcttcagtgcatgaaacatgcttagttaagattggaaaggcatgaaatgtatgggtagaagacatgaacagaaacatgttctaattgatggtaatcaggttctgtactatccatggttttaggcatccactgggggtcttggaactatgttctaaggataagggggtactgttgtacaagatggcagggaacaaggccaaagacagatcctgcagctcaggccaaactggaggatgtgggcctggttttcagtttgagtgggcaagcccaagtgactgttcagagatccaaacctgataggggctaaggccaagggatggtccaggcaaatggattggagagtcctggtagcttgcactgatacacttcatatgactgagcttaggatgagttccttgtgtctcactaccttttatagcagttttcctggcagataaggactaataggtatatgctcctccccagactggggatggctttggtaacaactggagagcatgcctgagtttcccaagtaacccccaaagtcctttttagggatctaatactcagtgatctaaacaataaaaggttgttttagtacacggaggataaattatccttgacattcattagcagcttaacattaacattaggcaaatacttaatacccctttacctcttatccactttctacttgacactctatctaccagacaaagctaggatgattctgagtgttggggaaacatgaatgggggctgactctgtgtgtgacactttcttctacaaagttggaatcaatttcagtgagttgttgattcggaattgtttgtcatcaccagccctggaagaatggaaatgtgatttcaagcactgtatccacttataaaattatactataactaaaaccttattttagttagcaaaaacaatagggttttcatttacttaagagagg

SEQ ID NO: 736493 - DNA, 540 bp, Homo sapiens
ggcagatctcagaaaggaagcggggcaggaatcaaggcatttcgaaacaggagagtgttttatcacaaacttcatcagtggccgaaaactcattcacgtcaactgctcaaacctccctcagatggggataacaaactttgaggacatgaaggcaatttctcggcatacgcaggagctcctggaaattgaagagccattattcaaacgctccatcagccttccctatagggatattatcggcttatatttagagcaaaaaggtcatactgggataaaatctgattccttgactttatctgaatttgtcaaagcagcaggattacaggattatgctccagaaataactgcccctgaagagaatgaggaattaccttgcactgaaccataggggaaatccacttcacagagcagaagaatcatttgaacccaggaaacagaggttatagtgagctgagatggtgccactggactccagcctgggtgacagagtgagactctgtctaaaacaaacaaacaaaacaaagcaaaacaaaattcctg

SEQ ID NO: 736494 - DNA, 1965 bp, Homo sapiens
gcggccgcttgaaaagctagctgacccaggggcggccacaggagctctggcccgctgaggctggcgatgaggccgcagggagggttactgcgtgcttgtgacagacgatttttaaagtcagggcttgaaagaacaaacaaaacctggggaagagtcaggaagacactgccggaaatcgtggtatccatagagacgctatcggaagttggggttgctaggaagccgcggcgcgtctgctaagctgcaaatggctgaagtcccggaggattatgattccggcccagatgaagatggagagctggagcctgagaggcctgaactgcctggacttcataaattgtatgaaaatgccgaaccagacaccatggcaaaggcagactcgaagctaccagcagagatttaccaagagccacagccagagaccgaggaagaggacttcaaagagggggagccagacagtgctaagaacgtgcagctgaaacctggcgggacgtcccaggaaggaattgccaaggagtccaagagagacgtaccaagcgaaactgaaccagggatacaccaagaggtaaagtcggaaacatccagagagatgggagagtttttcaaagatttggaggcccctatggatgaaacgcataaagagtcagacctagagccaccagaggaggctaaaccaaatgttacagaggatgtgttcctagagtcagctatggaaacagatccagatccagtgccaccaacggaaaccatgtctgaggtttcgggggccacagtcagagagagaaatttagaattactagaggaggagactgaaccgggggttccagaggaatcacttagagtgcaacatgaagagacaggtctagagcctccagagcagaccaaacaagattttccaagtgagaaactaggagaatcacttgaagagacagatcttcagccaccaaagatgaccaaaccagagactccagaggagacacaaagagagtcaactgagaagaaaaggacagagccacccgagcaggctagactggaatttctggagaaggaaccaagaaagtctagtgaggaggcaggtctagagcctccagaagagactcaaccagaggttccagaggagatgcaaagaaaggcaactgaggagaaagggacagaactacctgagcggactaaaccagactttccagaccacaagccaagaaagtctactgatgagaacgttcctgagccactagaagagatcaaattagagtttcctgaggaagaatcaagaaaaacaaatgaggaaacaattctagaacaatcagaaatgatgaaaccagaaagtccagaagagataagaaagtcaaatgagaaaaaaaatccacagccaccagaggagactggtccagtgctaccacaggagatcaacccacaagttgaagagaaaacacaaacaaagccaactgagaaaattctagagttaccagatgaaaccaaaccaagggagacacatgtagaattttccaaggaagacaggccagaaccaataaagtctaagtattctgtaggaaacgatgagctagagcaccgtgagcctaaaagaggaaagttgtcactaagtgacaaatttagaaaagaatattacgcattaggatctctcagagaaagtgaagaatcaattggtacacattatgagtttttgcaaccactccaaaaattgcttaatgtcagtgaagaatgctcatactcagatccctcagagtctcagacagaattaagtgagttcgttcatgaaaaggaagttgtagatttgtcccaagagttgaaggaacgggtctctgaagatgacgaaacccagccagaaaaagggactgagttacaatttgagcatcttaattgggatccagaggaagttgcagagtggattagccagctaggcttccctcaatacaaggtatacaaaaataagatgttttgaaatca

SEQ ID NO: 736495 - DNA, 438 bp, Homo sapiens
gggcgatctagaggatcccagcgcgagcttcatcaatacaaggagtgttttatcacaaacttcatcagtggccgaaaactcattcacgtcaactgctcaaacctccctcagatggggataacaaactttgaggacatgaaggcaatttctcggcatacgcaggagctcctggaaattgaagagccattattcaaacgctccatcagccttccctatagggatattatcggcttatatttagagcaaaaaggtcatactgggataaaatctgattccttgactttatctgaatttgtcaaagcagcaggattacaggattatgctccagaaataactgcccctgaagagaatgaggaattaccttgcactgaaccataggggaaatccacttcacagagcttgaaagatcaaactaaattacttgatggaagacggtat

SEQ ID NO: 736496 - DNA, 2332 bp, Homo sapiens
gcggccgcttgaaaagctagctgacccaggggcggccacaggagctctggcccgctgaggctggcgatgaggccgcagggagggttactgcgtgcttgtgacagacgatttttaaagtcagggcttgaaagaacaaacaaaacctggggaagagtcaggaagacactgccggaaatcgtggtatccatagagacgctatcggaagttggggttgctaggaagccgcggcgcgtctgctaagctgcaaatggctgaagtcccggaggattatgattccggcccagatgaagatggagagctggagcctgagaggcctgaactgcctggacttcataaattgtatgaaaatgccgaaccagacaccatggcaaaggcagactcgaagctaccagcagagatttaccaagagccacagccagagaccgaggaagaggacttcaaagagggggagccagacagtgctaagaacgtgcagctgaaacctggcgggacgtcccaggaaggaattgccaaggagtccaagagagacgtaccaagcgaaactgaaccagggatacaccaagaggtaaagtcggaaacatccagagagatgggagagtttttcaaagatttggaggcccctatggatgaaacgcataaagagtcagacctagagccaccagaggaggctaaaccaaatgttacagaggatgtgttcctagagtcagctatggaaacagatccagatccagtgccaccaacggaaaccatgtctgaggtttcgggggccacagtcagagagagaaatttagaattactagaggaggagactgaaccgggggttccagaggaatcacttagagtgcaacatgaagagacaggtctagagcctccagagcagaccaaacaagattttccaagtgagaaactaggagaatcacttgaagagacagatcttcagccaccaaagatgaccaaaccagagactccagaggagacacaaagagagtcaactgagaagaaaaggacagagccacccgagcaggctagactggaatttctggagaaggaaccaagaaagtctagtgaggaggcaggtctagagcctccagaagagactcaaccagaggttccagaggagatgcaaagaaaggcaactgaggagaaagggacagaactacctgagcggactaaaccagactttccagaccacaagccaagaaagtctactgatgagaacgttcctgagccactagaagagatcaaattagagtttcctgaggaagaatcaagaaaaacaaatgaggaaacaattctagaacaatcagaaatgatgaaaccagaaagtccagaagagataagaaagtcaaatgagaaaaaaaatccacagccaccagaggagactggtccagtgctaccacaggagatcaacccacaagttgaagagaaaacacaaacaaagccaactgagaaaattctagagttaccagatgaaaccaaaccaagggagacacatgtagaattttccaaggaagacaggccagaaccaataaagtctaagtattctgtaggaaacgatgagctagagcaccgtgagcctaaaagaggaaagttgtcactaagtgacaaatttagaaaagaatattacgcattaggatctctcagagaaagtgaagaatcaattggtacacattatgagtttttgcaaccactccaaaaattgcttaatgtcagtgaagaatgctcatactcagatccctcagagtctcagacagaattaagtgagttcgttcatgaaaaggaagttgtagatttgtcccaagagttgaaggaacgggtctctgaagatgacgaaacccagccagaaaaagggactgagttacaatttgagcatcttaattgggatccagaggaagttgcagagtggattagccagctaggcttccctcaatacaaggagtgttttatcacaaacttcatcagtggccgaaaactcattcacgtcaactgctcaaacctccctcagatggggataacaaactttgaggacatgaaggcaatttctcggcatacgcaggagctcctggaaattgaagagccattattcaaacgctccatcagccttccctatagggatattatcggcttatatttagagcaaaaaggtcatactgggataaaatctgattccttgactttatctgaatttgtcaaagcagcaggattacaggattatgctccagaaataactgcccctgaagagaatgaggaattaccttgcactgaaccataggggaaatccacttcacagagcttgaaagatcaaactaaattacttgatggaagacggtat

SEQ ID NO: 736497 - DNA, 1111 bp, Homo sapiens
gtagcaggatcagtatgaagataatacagtatctcttaaaacaggcagccagcaaatgaactttctgcattggtcagaatttccatcatttcactgttaatgaggaaagtacagttctttagctaccatgaaagtcaaacatatcctaagccttttggaaaaagacatacatgttagaaaatctcaaatggatgagtcagcctgactgaccccacattgactccattttatatgctggccaaatcctgtttctgactttcctggcacagccctggacatgcttctgtatcataggacttgttccccagcgcctttgctacttccttcaggcacattcctaggaaagattggcagtggggtttgctctttgccagcactcctgccggtttgggggttatggatgccaggttgggctccaggcactctgctctccatttgtggaggcagggacggtaacagcacctgacaagtagggatgatcacattgtattcagaagcctggtggagctctataaacccaaatttctaacagtctccaatgtaatgccctgtaatagaagctgtccttaaccctcaatcatctgtattcagctagtataaaaatgcaaatctgctcttatgcctaaacagttaggagtagaggagacttggcttcctttggaaagtcaggatgatagcttcatcccattctggtttttgtgattaattgtgacctacaaaggggtttactactctagcaggaactttgaatttcctatatacatctctttctggttagcaggcagaggaaatatcgttgacttttggcttcctggcaaatgtctcatttgccttgtcatttgttgattccttttccctgatctctgtttggtgtgataatgtacagcaaagctgaaaaccgcagggctacatgtacacttgtaggtacctatgttgtgattgccaaaaggctcagaaagccagttttctagtgaaaatggctaacattctaagaaatgctttcactgagaaagagaacgggtcaggggaaggtggaacttaaaggaagatggagtgttcctgaattcagattcctgaattagccatttatagtttcatgggaagacaatga

SEQ ID NO: 736498 - DNA, 705 bp, Homo sapiens
tacacaaatgttcatagcagctttatttttaatagcccaaaactagaaacaacccaatgtcctacaatagatgagtgagcagtcagacaaactggtacatccacagcaatctgttaaaaaacgaaaaactatcggtacatataataaaacttggatggaattcaagagcatcatactgtggaggggaaacccattctcaaaaagttaacatatgctatgtttgtatcacatatattatgccattcataacttcttgaaatgacaaaattacagtgaagattagtgatttccaggggttagggaaggtggtgaaaggatgggtgataaggtgtgacaataagtgggtagtacaagggttcctttgtggcaacggaacaattctgtatattatggtggtggttaaagtgcacaactacacacatacacacacacacacacgaactggtgaaatctgaataagacctggagtttagttaatagtaatgtgccagtcagtgttggtttcttagttttgacaaagttaccatgttaacattaagatattaacataagggggaaactggatgaagggtatataaggaactctgtactgtctttgtaacttttctgtaaatctaacattccaacataaaaacatttattttataaaagcaaagaaaaaatgctaatatgacactattacacatcaaccagaatagatgaaat

SEQ ID NO: 736499 - DNA, 848 bp, Homo sapiens
gaagagaaacatcacattatttatttccaaagaaaatagccaaatgcagcgccatgtacacaaaagcctttggagggaaaaggaatcacagatttaatatcatttacatttatatatttacaagatcaagccatggctttcaactttgttgttcattcaacaatcactttcagtcaaacaacttttattttcaagttagttcataatttaactgacactaaagagacagatgataaatcacaaacagtgtgggtagagagggtacaaatagtctaaagatttcagccaggcttttgtgtatatgtgaattatgattacaaaatgtttgcctgtctgtataattcacattcattgcaattattacattttctcataaattagcaatataaacaaacatatggagaccttcagttaacaaataaaatcaatatcaggaagaacattttgcagcaactataataacagcatgggttacagcttggaaaaacttctttacaagccatttattcagcacacacagagtagggggaccagcacatccttatttatttaaaccacctttaaaaccaccacaggagttttggggaaacctgaactgggtgaaagtttctttgctgggcacaatataaaatgaacaacttcacacgtgaatgaagggaaggatgggcatttacatgcattttcgatcactgtgttgtagaccaaaccttctaaacttcaattgccaagattctgaaggaaacaggaaattaataaaatatctctctccttcagctattctccttcttattaacggcagaaagggcttgttgattgctgctagtgagaagaaacacacaatgggtcta

SEQ ID NO: 736500 - DNA, 1474 bp, Homo sapiens
aaaaggtggggccggaggcggcgagctgagcggctctgacaggacgggtcgcagggggtcgcctggccggagctgggctccgagaatcccgggtgccagcaccagagcagcggctctccgcactaactctcctctcctggtcagctgtaacccctgccgcagagcccggcaactttcagctgtcgcccgcggagccccgagggccactcgcctcacctgtgcgtgcagcgcctcgcgcgccctgtccggctgcggagatgagcgagcttaataccaaaacatccccagcaaccaaccaggcagctggccaagaggaaaaaggaaaagctggcaatgtcaagaaggcggaggaggaggaggagattgacattgatctgacagcaccagaaacagagaaggctgcccttgctattcagggcaagttccggcgatttcagaaaaggaaaaaggatcccagctcctgaatggccaggcttgcccttcaccttcaccttcatgctggtcccttctctccccttctccacacccatgtatctttatcccttgtccctctagcctttccttgaggcaagttcaacctttatatactcttgtatctggccccctcaagccatcacagaagtagaggcacaagagaggtggagaagatgaagacttcaatcagcagtcactagtctaagggtggaacaatttcttcttggtataaggttctttgatcagtagctatgcctgccctgtagggctaaacaagaggcttcgaggctgagagatctccccaaagaacaatgtgggaaggaggggaaggctttcagagtagggtgcctgagggtgggacatatgcactgttctgctagttacggcattcacactttaggtaacattttttttccccttcagatccttctgcaccaactccaacttcccctcccaggatctaagccacagtggggactggagcctcgttttccccctaggcagacctaaatcaagcagcttaccacaatagtgcatgctgagtagattagttccaaggaagggagactggaatgctggtgtcaaggaaaagcctccctcatcatctagtctaagaccataacgggcagaagcataagaggttccagggccataggagaatgagaagtagggcacatatagggaggaaagaaaagtgaagaagggggaaatctctgaatttttttactgctgggaaaagtgtactacatgaaggatgcttggggctttgctaacctgctcaccgctaaccctccaagtctaaccatccccagaggccacacaaaccaagtgactcctgtagttcccatttgccccactatggagtcagggcaaaagtggaatagccactccatgtgattttagcatgtttaatcattttaacaataaaccaccccacaaatggggtcatttaacctctaaaaaaaaaaaaaaaaaaaaaaaaaaaaaaaaaaaaaaaaaa

SEQ ID NO: 736501 - DNA, 1273 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgttgttttcctaataataaagaaggag

SEQ ID NO: 736502 - DNA, 570 bp, Homo sapiens
tggatcactcaaatgcttcattaggttactaggtctctcctttcccactcccactgttatagatttactcaaagaatggaatgaactagtttcctgtcactctcatacttattctcttgaaaagttatgaaaaaggttggggagtaggtaggaaaaggggccaggagagttgcacagtaaattacatgacacgttaaacaatttgccacgctttaccttcctattacgtttctcgttttttttctcagagggctaaattttaacttcttagaggaagtgaagtctagagaagacctttcatttagaaaaagtaggatgggtttcctgccacctctcctagggttcttcttgtccactgttatttctaccattgcaactccacctcctctatgtctatctcttttccacttttatccagagccaggcacctacctgggttttggagtacacagaacccgagatatctggcacgcccgtgttactggaggtgactgaaacacctgggggaggaggaaacagacaggaggattagctcagctagctacctggcccttattcctgagatgaggt

SEQ ID NO: 736503 - DNA, 297 bp, Homo sapiens
gtcctttcccccactgcttatgtaagaggcaaaggaaagatctaaatggaaaaatgaagcaacataagcatggagaatcaggtatttctacaaatagtttcctttaccaactaatcaacaggtgggaaactgaggctgtttcccctccccccaccttcataaaaccaccatactgaaaaattaatagttctttggctatgctggggtttgattaaaaaggccaccctccacccttcatccacagcacagcattggttcctaggtccacaaagacagcacggaaagaacgccagagtt

SEQ ID NO: 736504 - DNA, 810 bp, Homo sapiens
  misc_feature (27)..(27): n is a, c, g, or t
tttttttttgtgtgtgtttttttttcnttagctaaagaaataccacagtttattgaagactacaaatatttttgttacaagttgaaactacatgccttccagaaatcaaaagcaacagcaggtgtgtgcattgatgcttcgaaggtgctgcaccgcttgaacttgaaatgggtaagacagggtcagacacatgggggagagggaaatgggggaggggcaagttcaaaagcccagaaggtatccaccaactcatttccccaagccacgcaggccatggcctcagctcagcaggctctcctcagtggtctggtttctgaaacaagacttcagtgcaaatttatacacacacacaaaacacagcccccagccttgggccaaattagctctcagccgtccagaaatgcttgtaagggggtggatattttcttcctaaaaggaatcaaatacataaaaataaatgaatggaatgacaaaagccctttgtggggttgggaactgggggttctcaagggctgatataatacgtttctgaattctgaagggaggcaagaaggtgggatttctagaatcaggtatgccaattctcttatattatccatcacctacctcttaaaattcgtgaacctggtccaactaagacttcaacctaatgtcctcagaaaggggccaccactccaagtcaaaaggcttataatcctccccaccaagatttagggtgaaccttgctcaatgacaggggtggccacaaggagtctatgtattaaatctcaatggggcttctcaggatttgtttaatttaactcatgaccc

SEQ ID NO: 736505 - DNA, 593 bp, Homo sapiens
  misc_feature (27)..(27): n is a, c, g, or t
tttttttttgtgtgtgtttttttttcnttagctaaagaaataccacagtttattgaagactacaaatatttttgttacaagttgaaactacatgccttccagaaatcaaaagcaacagcaggtgtgtgcattgatgcttcgaaggtgctgcaccgcttgaacttgaaatgggtaagacagggtcagacacatgggggagagggaaatgggggaggggcaagttcaaaagcccagaaggtatccaccaactcatttccccaagccacgcaggccatggcctcagctcagcaggctctcctcagtggtctggtttctgaaacaagacttcagtgcaaatttatacacacacacaaaacacagcccccagccttgggccaaattagctctcagccgtccagaaatgcttgtaagggggtggatattttcttccagtgttgtatccatgagacccatatccactcggctgttggaaaggggtggccgatgcattcacactgacattcacaccatgctgcttggaagaggtaggagccacgttcacactcaagctctctttttctcttcccaaaaatatttttcaattcattctttta

SEQ ID NO: 736506 - DNA, 1048 bp, Homo sapiens
  misc_feature (27)..(27): n is a, c, g, or t
tttttttttgtgtgtgtttttttttcnttagctaaagaaataccacagtttattgaagactacaaatatttttgttacaagttgaaactacatgccttccagaaatcaaaagcaacagcaggtgtgtgcattgatgcttcgaaggtgctgcaccgcttgaacttgaaatgggtaagacagggtcagacacatgggggagagggaaatgggggaggggcaagttcaaaagcccagaaggtatccaccaactcatttccccaagccacgcaggccatggcctcagctcagcaggctctcctcagtggtctggtttctgaaacaagacttcagtgcaaatttatacacacacacaaaacacagcccccagccttgggccaaattagctctcagccgtccagaaatgcttgtaagggggtggatattttcttccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatcctagaaaagaggggaaaaaagagcagagattcaatgtcactcattccccagcatgagtactatttccacggaggaaaaaacagaagaatgtgagagttgtgcaatttatccagtcactaattaagctggctagagttagcacaaactccacattactcttgcatacactgtcccccctgcctggccatgagcacagtcagacaaggtctacgg

SEQ ID NO: 736507 - DNA, 1266 bp, Homo sapiens
tggatcactcaaatgcttcattaggttactaggtctctcctttcccactcccactgttatagatttactcaaagaatggaatgaactagtttcctgtcactctcatacttattctcttgaaaagttatgaaaaaggttggggagtaggtaggaaaaggggccaggagagttgcacagtaaattacatgacacgttaaacaatttgccacgctttaccttcctattacgtttctcgttttttttctcagagggctaaattttaacttcttagaggaagtgaagtctagagaagacctttcatttagaaaaagtaggatgggtttcctgccacctctcctagggttcttcttgtccactgttatttctaccattgcaactccacctcctctatgtctatctcttttccacttttatccagagccaggcacctacctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggcgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcttcaaaagggggagcagtgg

SEQ ID NO: 736508 - DNA, 462 bp, Homo sapiens
  misc_feature (455)..(455): n is a, c, g, or t
caggaccttatagcaaatacttaaatgcaccaagtagtcatgtaccaccagcagctgttactcaatgcactacctgcctaactccacttctggtgccctacccaaccaccaatctcttcctgggataaatccgacaatcagatattggacttacacaagtgcacttgccctttccatagtgtggttccacagagtcctgttcatgcccagtctccttcatataacatatgtgaaatgttctggctcagaacactattttggatgtaaaagttttgggtcagaatcttaagggtgaattttgaggggtagaaacatacccattttctatccctaaacaacacttagggatagaaggcattagtgaggaatgacctgggaatacctacatcttcattccaatcttcagtcccccactcctctgttgcagtcctccatgcactcgtcccatatctggntcaagtt

SEQ ID NO: 736509 - DNA, 1174 bp, Homo sapiens
  misc_feature (1137)..(1137): n is a, c, g, or t
  misc_feature (1146)..(1146): n is a, c, g, or t
  misc_feature (1156)..(1156): n is a, c, g, or t
caccaccgcactcagctaattgaaaacaatttttttagaaatggagtcttgatatgttgctcaggctgttcttgaactcctaaggctcaggctgtcctcccacttcaacctcccaaagtgctaggattacaggtgtaagctaccatgcccagcctctaaatgtgatgagaaatacatagcctcaaattttattattccccaacttcttgaattcagcttatttgattaggggaaatacatgtgggaaggtaaccaactagctgccccttttcttcacttcaggacacattctccaccccctccccctgctagcctcttgacagtaatgctccaatgctttaaagattcaagtcactttccatcttctcaccatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaancggacgcgnggtcgacgantccggaaattccggaccc

SEQ ID NO: 736510 - DNA, 406 bp, Homo sapiens
atcgagaccgggacagagactatagtcggcgacgtggtgggccaccaagacgggggagaggtgccagtcgtggacgagagtttcgaggtcaggaaaatggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtgccctgcttgtgctgtgtctgttttgtttgagtgggagagtgaagg

SEQ ID NO: 736511 - DNA, 697 bp, Homo sapiens
gcagtgcacgctgattcctgctagtctgatctagagttatccccctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatactcaggcaaggcccaggcctcgctcgctcgcgctctttctcgctctcccctctcaggctctagccgcat

SEQ ID NO: 736512 - DNA, 4592 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggcgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatactcaggcaaggcccaggcctcgctcgctcgcgctctttctcgctctcccctctcaggctctagccgcat

SEQ ID NO: 736513 - DNA, 3619 bp, Homo sapiens
  misc_feature (27)..(27): n is a, c, g, or t
tttttttttgtgtgtgtttttttttcnttagctaaagaaataccacagtttattgaagactacaaatatttttgttacaagttgaaactacatgccttccagaaatcaaaagcaacagcaggtgtgtgcattgatgcttcgaaggtgctgcaccgcttgaacttgaaatgggtaagacagggtcagacacatgggggagagggaaatgggggaggggcaagttcaaaagcccagaaggtatccaccaactcatttccccaagccacgcaggccatggcctcagctcagcaggctctcctcagtggtctggtttctgaaacaagacttcagtgcaaatttatacacacacacaaaacacagcccccagccttgggccaaattagctctcagccgtccagaaatgcttgtaagggggtggatattttcttccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggcgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatactgcgcctatccgggctttgactccttattccaggagtaggtgggagtttaagtcacttagtcgggccgacccgccctcgttagtctagaaccctccctttaacgctagagcacagaccccacgcctccctgctgctggcttcttagatccacccccatcataacggccttgctttgccccaagttttaccctgaaacattcctgagagccggaatctggggatttggaatgaaggcatgctttttta

SEQ ID NO: 736514 - DNA, 639 bp, Homo sapiens
ccgcccgcgttttttttttttggggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgaggagattaccccaccccattcctgctgtcgcatcttacccagtagagaccctccttttgagctgtaccccgtctgcattctccacccactcacctgcgcctatccgggctttgactccttattccaggagtaggtgggagtttaagtcacttagtcgggccgacccgccctcgttagtctagaaccctccctttaacgctagagcacagaccccacgcctccctgctgctggcttcttagatccacccccatcataacggccttgctttgccccaagttttaccctgaaacattcctgagagccggaatctggggatttggaatgaaggcatgctttttta

SEQ ID NO: 736515 - DNA, 1038 bp, Homo sapiens
  misc_feature (3)..(3): n is a, c, g, or t
  misc_feature (11)..(11): n is a, c, g, or t
tanggctagtncgaggctggtgttgaatcggccgaggatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggggctctgcgtgattagcagtcgtgctgtgcgaccggtgttgcggcctcgaattgccaggccagttcccagccggtcgcgttacgggtggggtccccccttgttgattggaattcccgtggtgggggggtggagaatggaccccccttggagtcttgggggggggggggcgcttgct

SEQ ID NO: 736516 - DNA, 934 bp, Homo sapiens
  misc_feature (3)..(3): n is a, c, g, or t
  misc_feature (11)..(11): n is a, c, g, or t
  misc_feature (849)..(849): n is a, c, g, or t
  misc_feature (853)..(853): n is a, c, g, or t
tanggctagtncgaggctggtgttgaatcggccgaggatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaagggcnggantaagcccgcctggcattggcaaaggttgtggcgcggccctcgaaattggccaggccaatggttcaccatccggtccacgta

SEQ ID NO: 736517 - DNA, 576 bp, Homo sapiens
tcgaccggccgtggggatgcctcctccccagccccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggcgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtgtggagcatgtgaccg

SEQ ID NO: 736518 - DNA, 3197 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctatccaggaggccaggaggagacagagtaaaagggatcagcaaactagtcttgggatttttcctgagctcaagctccctgaccctcagaaagcagcatggtgtcacagaaggcacagtacacttgaagtcacatattcaggtctcagtctcagctctgctcttatttaagaactgtgtgaacctgggcatactactcaatctcttagcctcagtttcctcagatataaaacagggatgctacaaacctgttgtaaagaccaaataggctgggcatggtggctcacatctgtaatcccagcactttgggaggccaagatgggtggatcacacaaggtcaggagtttaagaccagtctggccaatatggtgaaaccccgtctctactaaaaatacaaaaattagccgggcatggtggcgggcgcctgtaatccagctacttgggagtctgaggcaggagaatcacttgaacctgggaggtggaggttgcagtgagtcaagactgtgccactgcactccagcctgggagacagagggagactccatctcaaaaaaaaaagactaaagaatgagaagagatatcattgtgctgttttctccacagagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgccgtgagtttggaggggaacgtgtcagagggagctggtacagtagtgttggactgttgccacagtgcagtgaccttcataaagcatataaacaaaatccatgataccataagagttgtcaggttctagactattagatcagtctcttacattagaaagcagatgcggccgggcacagtggttcacgcctataatcccagcactttgggaggccgaggcgggaggatcatctgaggttgggaatccgagaccagcctgaccaacatggagaaaccccgttctctactaaaaatacaaaattagccgggcgtggtggcgcatgcctgtaatcctagcttctggggaggctgaggcaggagaatctcttgaacccgggaggcggaggttgcggtgagccaagatcgtgccattatactccagcctgggcaacaaaagtgaaactctgtctcaaaaaaaaaaaagaagaaaagaaagcagatgcaactatacaagctagtaaaagaagtttttactagcatttttcttgtgtgcatttttcttgtcttttgtttagcccaataaaatgtcaaaattggtgtagcctagcaaagggaatagtttttcagcacacacagggattccttctcttcagagtctcagcgtcccttttgtgtcttggcccaataaaagtaagaattaaataacattgggccgggcgcggtggctcacgcctgtaatcccagcactttgggaggccgaggcaggcgaatcatgaggtcaagagatcaagaccatcctagccaacaaggtgaaaccctgtctctactaaaaatacaaaaattagctgggcatggtggtgcgtgcctgtaatctcagcta

SEQ ID NO: 736519 - DNA, 3949 bp, Homo sapiens
  misc_feature (1)..(2): n is a, c, g, or t
  misc_feature (3294)..(3294): n is a, c, g, or t
  misc_feature (3313)..(3313): n is a, c, g, or t
  misc_feature (3316)..(3316): n is a, c, g, or t
  misc_feature (3320)..(3320): n is a, c, g, or t
  misc_feature (3323)..(3323): n is a, c, g, or t
  misc_feature (3325)..(3325): n is a, c, g, or t
  misc_feature (3331)..(3331): n is a, c, g, or t
  misc_feature (3431)..(3431): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctatccaggaggccaggaggagacagagtaaaagggatcagcaaactagtcttgggatttttcctgagctcaagctccctgaccctcagaaagcagcatggtgtcacagaaggcacagtacacttgaagtcacatattcaggtctcagtctcagctctgctcttatttaagaactgtgtgaacctgggcatactactcaatctcttagcctcagtttcctcagatataaaacagggatgctacaaacctgttgtaaagaccaaataggctgggcatggtggctcacatctgtaatcccagcactttgggaggccaagatgggtggatcacacaaggtcaggagtttaagaccagtctggccaatatggtgaaaccccgtctctactaaaaatacaaaaattagccgggcatggtggcgggcgcctgtaatccagctacttgggagtctgaggcaggagaatcacttgaacctgggaggtggaggttgcagtgagtcaagactgtgccactgcactccagcctgggagacagagggagactccatctcaaaaaaaaaagactaaagaatgagaagagatatcattgtgctgttttctccacagagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaanaaaaaaaaaaaaaaaaaanaanaaanaananaaaaanaaaaaaaaaaaaaaaaaaaaaaaaaacaaaagtaaacaaaagaaaaaagaaaaaaggagagaggaggagcggcgccgaccgacaacaaataaccaaattncaccagcgaggagaagcaagacagtaagacgacgctgcgcaggctcgacgtgccttggagacgagggggaggcgccggcgcgacgagcgacgagtgcgtccacaaacccagtagacgagagcgaggcgcagacgagcaccgacatatcacacgaagagtcggctggggggagaagcaatgataacagtctaacgcagagatctaattgtgggttctcgtctgatgaattacggggacgacacccgtataaaagagtagcgggccgtgggagttcacaatctgttctgtgagaaggacaagaacaagccaatacaaaacataaaggacgacgtcgatgtatagatcctattacgttacgatcgagtataaagaaattaagttagctgtctagtgcagatacgtctgttgaggtggagtgagccgaaaaaagaactgcaggtgtacgattagttgtcgcagaggaggtaagtgacaactcatgcggtcttctaacgtgtcggatgcatcgtgcgagccaa

SEQ ID NO: 736520 - DNA, 1651 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacacctgggggaggaggaaacagacaggaggattagctcagctagctacctggcccttattcctgagatgaggt

SEQ ID NO: 736521 - DNA, 2387 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattctgggttagaacaggacacggattatttccttcaattttatttaaggaaaaagcagtaaagtacacagagattaaatgattcatgaaaggtcttgaagctttccttgagctaaatactactgattctagtaggctggcttcttgataccaatagagtagacacaaaacatacacgaacaaccagttttactctctattctacaagtctctgtctcttatactcttcaaaatctggcttaaaaata

SEQ ID NO: 736522 - DNA, 4368 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattcttttgaagaagatcctttagtcccacttaccgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaactgaaataaaaataaaaattaaaacaacaacaacaacaaaaaaaccaaaccacagatggccagagcacagtcaacaggatatatacaaatatataaatggtatgtaatatggtattgggaattaaaaaaacaacgaagagaaaatgagctggaaggatgggaacatgtttctcagggaatggtaatgtgccttaatggaga

SEQ ID NO: 736523 - DNA, 4710 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattcttttgaagaagatcctttagtcccacttaccgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatactcagtctcctccacactgacaccccgggccgcgccgcccctgtcacgtgatata

SEQ ID NO: 736524 - DNA, 4775 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattcttttgaagaagatcctttagtcccacttaccgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaataccggccccgccgcgctgccgctgccgccgccgccgccgccaacgccgctgcgctcccaactttacctcagtctcctccacactgacaccccgggccgcgccgcccctgtcacgtgatata

SEQ ID NO: 736525 - DNA, 5505 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattcttttgaagaagatcctttagtcccacttaccgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatacttcctgcgtccctcagcgcgtgacgctaaaaggggcgcgcacgcaagcgtgcgcgtgccgcctcgccacgagacacctctttccggctccgcgagtccaccccgcctccttcacggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgaggagattaccccaccccattcctgctgtcgcatcttacccagtagagaccctccttttgagctgtaccccgtctgcattctccacccactcacctgcgcctatccgggctttgactccttattccaggagtaggtgggagtttaagtcacttagtcgggccgacccgccctcgttagtctagaaccctccctttaacgctagagcacagaccccacgcctccctgctgctggcttcttagatccacccccatcataacggccttgctttgccccaagttttaccctgaaacattcctgagagccggaatctggggatttggaatgaaggcatgctttttta

SEQ ID NO: 736526 - DNA, 6516 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattcttttgaagaagatcctttagtcccacttaccgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatacttcctgcgtccctcagcgcgtgacgctaaaaggggcgcgcacgcaagcgtgcgcgtgccgcctcgccacgagacacctctttccggctccgcgagtccaccccgcctccttcacggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgccgtgagtttggaggggaacgtgtcagagggagctggtacagtagtgttggactgttgccacagtgcagtgaccttcataaagcatataaacaaaatccatgataccataagagttgtcaggttctagactattagatcagtctcttacattagaaagcagatgcggccgggcacagtggttcacgcctataatcccagcactttgggaggccgaggcgggaggatcatctgaggttgggaatccgagaccagcctgaccaacatggagaaaccccgttctctactaaaaatacaaaattagccgggcgtggtggcgcatgcctgtaatcctagcttctggggaggctgaggcaggagaatctcttgaacccgggaggcggaggttgcggtgagccaagatcgtgccattatactccagcctgggcaacaaaagtgaaactctgtctcaaaaaaaaaaaagaagaaaagaaagcagatgcaactatacaagctagtaaaagaagtttttactagcatttttcttgtgtgcatttttcttgtcttttgtttagcccaataaaatgtcaaaattggtgtagcctagcaaagggaatagtttttcagcacacacagggattccttctcttcagagtctcagcgtcccttttgtgtcttggcccaataaaagtaagaattaaataacattgggccgggcgcggtggctcacgcctgtaatcccagcactttgggaggccgaggcaggcgaatcatgaggtcaagagatcaagaccatcctagccaacaaggtgaaaccctgtctctactaaaaatacaaaaattagctgggcatggtggtgcgtgcctgtaatctcagcta

SEQ ID NO: 736527 - DNA, 6287 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattcttttgaagaagatcctttagtcccacttaccgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatacttcctgcgtccctcagcgcgtgacgctaaaaggggcgcgcacgcaagcgtgcgcgtgccgcctcgccacgagacacctctttccggctccgcgagtccaccccgcctccttcacggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgccgtgagtttggaggggaacgtgtcagagggagctggtacagtagtgttggactgttgccacagtgcagtgaccttcataaagcatataaacaaaatccatgataccataagagttgtcaggttctagactattagatcagtctcttacattagaaagcagatgcggccgggcacagtggttcacgcctataatcccagcactttgggaggccgaggcgggaggatcatctgaggttgggaatccgagaccagcctgaccaacatggagaaaccccgttctctactaaaaatacaaaattagccgggcgtggtggcgcatgcctgtaatcctagcttctggggaggctgaggcaggagaatctcttgaacccgggaggcggaggttgcggtgagccaagatcgtgccattatactccagcctgggcaacaaaagtgaaactctgtctcaaaaaaaaaaaataaaatataaaaagaaaaaaaaaatggggggggttttttgtgggggggggaaacaagaggtttataaaaggggaaggggtataggggttctgggaccatttttttttaaaagggggaaataggggggggccaaaaaggggggggataattgaaaagggggtaacctgt

SEQ ID NO: 736528 - DNA, 7157 bp, Homo sapiens
  misc_feature (1)..(2): n is a, c, g, or t
  misc_feature (6613)..(6613): n is a, c, g, or t
  misc_feature (6632)..(6632): n is a, c, g, or t
  misc_feature (6635)..(6635): n is a, c, g, or t
  misc_feature (6639)..(6639): n is a, c, g, or t
  misc_feature (6642)..(6642): n is a, c, g, or t
  misc_feature (6644)..(6644): n is a, c, g, or t
  misc_feature (6650)..(6650): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattcttttgaagaagatcctttagtcccacttaccgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatacttcctgcgtccctcagcgcgtgacgctaaaaggggcgcgcacgcaagcgtgcgcgtgccgcctcgccacgagacacctctttccggctccgcgagtccaccccgcctccttcacggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 736529 - DNA, 7268 bp, Homo sapiens
  misc_feature (1)..(2): n is a, c, g, or t
  misc_feature (6613)..(6613): n is a, c, g, or t
  misc_feature (6632)..(6632): n is a, c, g, or t
  misc_feature (6635)..(6635): n is a, c, g, or t
  misc_feature (6639)..(6639): n is a, c, g, or t
  misc_feature (6642)..(6642): n is a, c, g, or t
  misc_feature (6644)..(6644): n is a, c, g, or t
  misc_feature (6650)..(6650): n is a, c, g, or t
  misc_feature (6750)..(6750): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattcttttgaagaagatcctttagtcccacttaccgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatacttcctgcgtccctcagcgcgtgacgctaaaaggggcgcgcacgcaagcgtgcgcgtgccgcctcgccacgagacacctctttccggctccgcgagtccaccccgcctccttcacggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaanaaaaaaaaaaaaaaaaaanaanaaanaananaaaaanaaaaaaaaaaaaaaaaaaaaaaaaaacaaaagtaaacaaaagaaaaaagaaaaaaggagagaggaggagcggcgccgaccgacaacaaataaccaaattncaccagcgaggagaagcaagacagtaagacgacgctgcgcaggctcgacgtgccttggagacgagggggaggcgccggcgcgacgagcgacgagtgcgtccacaaacccagtagacgagagcgaggcgcagacgagcaccgacatatcacacgaagagtcggctggggggagaagcaatgataacagtctaacgcagagatctaattgtgggttctcgtctgatgaattacggggacgacacccgtataaaagagtagcgggccgtgggagttcacaatctgttctgtgagaaggacaagaacaagccaatacaaaacataaaggacgacgtcgatgtatagatcctattacgttacgatcgagtataaagaaattaagttagctgtctagtgcagatacgtctgttgaggtggagtgagccgaaaaaagaactgcaggtgtacgattagttgtcgcagaggaggtaagtgacaactcatgcggtcttctaacgtgtcggatgcatcgtgcgagccaa

SEQ ID NO: 736530 - DNA, 7273 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattcttttgaagaagatcctttagtcccacttaccgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatacttcctgcgtccctcagcgcgtgacgctaaaaggggcgcgcacgcaagcgtgcgcgtgccgcctcgccacgagacacctctttccggctccgcgagtccaccccgcctccttcacggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaaaaaccaacaacaaagagaggcgcgcgggcgcgcctcagagagagtttctccccgtgcgagagcggcgcccccaagagcttctctgcgcgcgccgtttccccccgaagtgactatgtccacgtggctcataaccaaatgcgggtgggttctgccccaattagatgagaggcgagacgacctgcaggcctcacctcatcactattagacggccccctgagggcgcacacagacgctgcgcccagcggctgcgcaggtctttattcaataccacaagacgaagttccagcggggctcgcaccacgcggggggcgtacaacaaacaaccggccgtggtgcacagccaaccgccacatgttgaggcagcactaaccctcttgatgccgaggctgatcgacagcagagccgacaaacacccccttctaaagcccctacctcctcgcctgtgcagacggcgaccgtggcggacgcacacccacactattcaatcctccggtcggggcggcaccacaaacaacgaaccactaaactctgcatactaacacaaacagacgacagactactttctctcacagcagcgcgcacctcactcatatctgcgcgcgcatcaccacatcccatgatagcacaagacgctacctcccacaacagcacggccagacgagcacaccatactaaacgagcggctggct

SEQ ID NO: 736531 - DNA, 6522 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattcttttgaagaagatcctttagtcccacttaccgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatacttcctgcgtccctcagcgcgtgacgctaaaaggggcgcgcacgcaagcgtgcgcgtgccgcctcgccacgagacacctctttccggctccgcgagtccaccccgcctccttcacggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcactgtttggactctgggcactgtttggactctgggcactgtttggactctg

SEQ ID NO: 736532 - DNA, 6418 bp, Homo sapiens
  misc_feature (1)..(2): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattcttttgaagaagatcctttagtcccacttaccgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatacttcctgcgtccctcagcgcgtgacgctaaaaggggcgcgcacgcaagcgtgcgcgtgccgcctcgccacgagacacctctttccggctccgcgagtccaccccgcctccttcacggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagaagccagctagggtgggatcctctagatacgt

SEQ ID NO: 736533 - DNA, 7224 bp, Homo sapiens
  misc_feature (1)..(2): n is a, c, g, or t
  misc_feature (6569)..(6569): n is a, c, g, or t
  misc_feature (6588)..(6588): n is a, c, g, or t
  misc_feature (6591)..(6591): n is a, c, g, or t
  misc_feature (6595)..(6595): n is a, c, g, or t
  misc_feature (6598)..(6598): n is a, c, g, or t
  misc_feature (6600)..(6600): n is a, c, g, or t
  misc_feature (6606)..(6606): n is a, c, g, or t
  misc_feature (6706)..(6706): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattcttttgaagaagatcctttagtcccacttaccgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatacttcctgcgtccctcagcgcgtgacgctaaaaggggcgcgcacgcaagcgtgcgcgtgccgcctcgccacgagacacctctttccggctccgcgagtccaccccgcctccttcacggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaaagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaanaaaaaaaaaaaaaaaaaanaanaaanaananaaaaanaaaaaaaaaaaaaaaaaaaaaaaaaacaaaagtaaacaaaagaaaaaagaaaaaaggagagaggaggagcggcgccgaccgacaacaaataaccaaattncaccagcgaggagaagcaagacagtaagacgacgctgcgcaggctcgacgtgccttggagacgagggggaggcgccggcgcgacgagcgacgagtgcgtccacaaacccagtagacgagagcgaggcgcagacgagcaccgacatatcacacgaagagtcggctggggggagaagcaatgataacagtctaacgcagagatctaattgtgggttctcgtctgatgaattacggggacgacacccgtataaaagagtagcgggccgtgggagttcacaatctgttctgtgagaaggacaagaacaagccaatacaaaacataaaggacgacgtcgatgtatagatcctattacgttacgatcgagtataaagaaattaagttagctgtctagtgcagatacgtctgttgaggtggagtgagccgaaaaaagaactgcaggtgtacgattagttgtcgcagaggaggtaagtgacaactcatgcggtcttctaacgtgtcggatgcatcgtgcgagccaa

SEQ ID NO: 736534 - DNA, 6926 bp, Homo sapiens
  misc_feature (1)..(2): n is a, c, g, or t
  misc_feature (6382)..(6382): n is a, c, g, or t
  misc_feature (6401)..(6401): n is a, c, g, or t
  misc_feature (6404)..(6404): n is a, c, g, or t
  misc_feature (6408)..(6408): n is a, c, g, or t
  misc_feature (6411)..(6411): n is a, c, g, or t
  misc_feature (6413)..(6413): n is a, c, g, or t
  misc_feature (6419)..(6419): n is a, c, g, or t
nntttacagtagtccattcctagggggaatgggccccaaggttttgtttttttatttcgtttttggggtacaggtggtgtttggttacatggatgagttctttagtgatttctgcgactttagcgcacccatcacccgagcagtgtacactgtacccaatatgtagtctttcatccctcaccccactccaagatttagttctgccagacgatacatgttgccttcacttctttttagtttatttgcctggacccatctaagtcatacttaaaactctataaagcattttttttctttgaaatggtctcagctccttcttgatcctctccattttccacccaatctcctctatccctctccctttactgcctgaaatcggctgtagatgtagcagtttctggaggaaatgaagatttgtggtggttctttccagtcaccaggttgtgaaagtcttaggggtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaactgtagccaggaggcagcgccgggttcaggaatgtctgctgcgtggtatggtgagtctgcgtctggttctgttggggttgggccaaggttgtggccggggctggggaggaggcatccccacggccgaactttgtgaggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggctgaaagatacagacatatagcaataacaggaactggtcatgatgttagcaaaacaaggagccaagagacaagctaattcaacagaacattcatcctcattcttttgaagaagatcctttagtcccacttaccgggtaggcatgtaacagccctggagccataatatacggattaggcaacaacggcgggaccccaggagggaggttgggaggagcttttcctgaagtcgtagcaactgagcttcgagtcgaggctgtgacagtggagttgctgcctaggctgaggcccaggctactgccactattgagactggaggagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatacttcctgcgtccctcagcgcgtgacgctaaaaggggcgcgcacgcaagcgtgcgcgtgccgcctcgccacgagacacctctttccggctccgcgagtccaccccgcctccttcacggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaatctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 736535 - DNA, 1287 bp, Homo sapiens
tgcgcgctgctcttccccgcggagcccgcgcagtccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttgtaagctactacaggagggagaaggggaacgggattcagctacagtatctgatctactttgacttttaggagacagccctgtagcctagtagttcaaagcgcagcttctggaaaaggctgtcggggtttgtatcctggctcctgcacttattaacccataaaaagtaacttggtcaagttactcac

SEQ ID NO: 736536 - DNA, 796 bp, Homo sapiens
tttcctttacatcagtttctgcacataatattggaaaagcattctagaaagcactaaaggtattgtgctacttcttttctgaagaaattctttactaattttcttttctttatttttttgagatcgagtctcgctctgtcacccaggctggagcacagtggtgcaatctcggctcactgcaacctctgcctcccaggttcaagggattatccagcctcagccacccaagtagctaggattacaggtgtgcgacaccatgcctggctaatttttgtatttttagtagagacagggtttcgacctgtcggccaggctggtcttgaactcctgagctcacatgatctgcccacctcggcctcccaaagtgctgggattacaggggagcaccagcacacccggctaaattttgtatttttagtagagaaggggttttgacaggctggtctggaactcctgagctcacatgatctgcccacctcggcctcccaaagtgctgggattacaggcatgagccactgagcccgttccctttactaattttctatcaagtcatagttcttacaaagtgggtatttttggtatgattctactttatgaattgttttcaaagcacaaagaaagcgactgcgtattagaccacacagcaaatcagagaataggcagagctagtgagtagagcttccagttggagatttgggttcattaccttacctacttgtcaaccacatctcaagatatgatgacagttaccaggtcttggaaagatgcgtgttataagatcctctagagtaccttg

SEQ ID NO: 736537 - DNA, 768 bp, Homo sapiens; identical to SEQ ID NO: 283654

SEQ ID NO: 736538 - DNA, 463 bp, Homo sapiens
ccagataattttttgtatttttagtagcgatagggtttcaccgtgttagccaggagggtctcgatctcctgacctcacgatccacccacctcgggctcccaaagtgctggaattacagtcatgtgcctaccacccagcctttttttaattattatttgaagaatttaagattggaattaattgctccttgaatgtttggtagactcatctgtaataccatttgagcctagaatattctggtttttttgagacggagtcttgccctattgcccaggccggagtgcagtgggattacacgcgtgagccaccatgcctggccagaatattctttattgtaaaatttaaagctgtaatttcaatgtcttgaagagttatagatctaattagattttccatttctcctggagtcaatttggtacaaacagtcaataaagactacaagaccagtttaagtaaaaaaaaa

SEQ ID NO: 736539 - DNA, 2237 bp, Homo sapiens
tgcgcgctgctcttccccgcggagcccgcgcagtccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaataaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagatgctgggattacaggcgtgaagcaccacgcccagcctgaaataatattttaccttttactttgtgctttttgtgttttactcaggaagtcctcccctacatctgttttcttctgtatttcttttcatatttaggtctttaatccacctggattttttgtttgggtttttgttgttctttagtcaaagatccaattcttttttctatttaaataaccatcattgactgactagtccatccttaccccacccctactgattatgatgtcactgctgtcacatattgtcatacgtggggggctgttactgggttctccagtctcctcccctttatctgtttgtgtatccctgtgctggtgccacactgcctcgttcactgatgtttttaataagcctgcaccatttgtatgtcaattcttcctgctcttcttatccatcaaaaatcactttaacttttcttgttcctttactcttccatataaattgtttattcaaccatcaggttccaggaaaaagcctgttagtattttcattggacttacatggaatttgtagattttgaaaaaacagatatttttatgagtcttcctattcataaaaatagtatgtctccatttacttatgtctttaagtgtatttcagtaaagctttctatcttttccacattggtcagctcctctttttattagaattattccc

SEQ ID NO: 736540 - DNA, 2247 bp, Homo sapiens
tgcgcgctgctcttccccgcggagcccgcgcagtccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaataaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagatgctgggattacaggcgtgaagcaccacgcccagcctgaaataatattttaccttttactttgtgctttttgtgttttactcaggaagtcctcccctacatctgttttcttctgtatttcttttcatatttaggtctttaatccacctggattttttgtttgggtttttgttgttctttagtcaaagatccaattcttttttctatttaaataaccatcattgactgactagtccatccttaccccacccctactgattatgatgtcactgctgtcacatattgtcatacgtggggggctgttactgggttctccagtctcctcccctttatctgtttgtgtatccctgtgctggtgccacactgcctcgttcactgatgtttttaataagcctgcaccatttgtatgtcaattcttcctgctcttcttatccatcaaaaatcactttaacttttcttgttcctttactcttccatataaattgtttattcaaccatcaggttccaggaaaaagcctgttagtattttcattggacttacatggaatttgtagattttgaaaaaacagatatttttatgagtcttcctattcataaaaatagtatgtctccatttacttatgtctttaagtgtatttcagtaaagctttctatcttttcacaaaataaaaaaaaaaactttagggggggcccggaccaaattcccct

SEQ ID NO: 736541 - DNA, 2877 bp, Homo sapiens
tgcgcgctgctcttccccgcggagcccgcgcagtccgcgcagccctcatcgcaactgggcccgcgcgcaggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaacgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcagtaagtttgttgttgaactgaaatgaatttcattatttcctccaatgtgtacttttgtgcccccctctcacttctccctatcatgacccctcttttgctgaaaaaaatttttattattttttctatctctagttctagaaagagaaaatttattttttaaattataaactattttgccaggcgccatggctcacacctgtaatctcagcactttgggaggccgaggcaggtggatcacctgaggtcaggagttcaagactagcctggccaatatggtgaaaccctgtctctactaaaaaaacaaaaaaaatcagctgggtgtggtggcgggggcctgtagtctcaactactcgggaggttgaggcaggagaattgcttgaacctgggaggtggagattgcagtgagctgaaatcacgccactgcactcgagcctgggcaactgagcgagactctgtctcaaaaaaaaaaggccaggcatggtggctcatgcctgtaatcctagtactttgggaggctgaggtgggcagaatacaaggtcaagagatcaagaccatcctggccaacatggtgaaaccccatctctataaaaatacaaaaattagccaggcatggtggtgcacgcctgtaatcccagctacttgggaggctgaggcaggagaattgcttgagcctgggaggcagaggttgcagtgagctgagatattgcaccactgcactctagcctgggtgacagagcgagactccatctcaaaaaaaaaaaaaaaaaaagaatatacatactatttttctagaagatgccacagtttcttccaaattggctgtaccaatttaagttcctacaatttgtgtttaagagttcccactttttcatgttcttgctaacgttcagagttatcatatttttaaatgtttgctaatctggtggatgaaaactggtaaactattgttattttttttccttttcatcatttt

SEQ ID NO: 736542 - DNA, 3060 bp, Homo sapiens
tgcgcgctgctcttccccgcggagcccgcgcagtccgcgcagccctcatcgcaactgggcccgcgcgcaggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaacgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcagtaagtttgttgttgaactgaaatgaatttcattatttcctccaatgtgtacttttgtgcccccctctcacttctccctatcatgacccctcttttgctgaaaaaaatttttattattttttctatctctagttctagaaagagaaaatttattttttaaattataaactattttgccaggcgccatggctcacacctgtaatctcagcactttgggaggccgaggcaggtggatcacctgaggtcaggagttcaagactagcctggccaatatggtgaaaccctgtctctactaaaaaaacaaaaaaaatcagctgggtgtggtggcgggggcctgtagtctcaactactcgggaggttgaggcaggagaattgcttgaacctgggaggtggagattgcagtgagctgaaatcacgccactgcactcgagcctgggcaactgagcgagactctgtctcaaaaaaaaaaggccaggcatggtggctcatgcctgtaatcctagtactttgggaggctgaggtgggcagaatacaaggtcaagagatcaagaccatcctggccaacatggtgaaaccccatctctataaaaatacaaaaattagccaggcatggtggtgcacgcctgtaatcccagctacttgggaggctgaggcaggagaattgcttgagcctgggaggcagaggttgcagtgagctgagatattgcaccactgcactctagcctgggtgacagagcgagactccatctcaaaaaaaaaaaaaaaaaattattttattatgcacaaaaggattaacaaataatatgtccactcatgtgcctaccacccagcctttttttaattattatttgaagaatttaagattggaattaattgctccttgaatgtttggtagactcatctgtaataccatttgagcctagaatattctggtttttttgagacggagtcttgccctattgcccaggccggagtgcagtgggattacacgcgtgagccaccatgcctggccagaatattctttattgtaaaatttaaagctgtaatttcaatgtcttgaagagttatagatctaattagattttccatttctcctggagtcaatttggtacaaacagtcaataaagactacaagaccagtttaagtaaaaaaaaa

SEQ ID NO: 736543 - DNA, 2828 bp, Homo sapiens
tgcgcgctgctcttccccgcggagcccgcgcagtccgcgcagccctcatcgcaactgggcccgcgcgcaggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaacgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcagtaagtttgttgttgaactgaaatgaatttcattatttcctccaatgtgtacttttgtgcccccctctcacttctccctatcatgacccctcttttgctgaaaaaaatttttattattttttctatctctagttctagaaagagaaaatttattttttaaattataaactattttgccaggcgccatggctcacacctctgcctcggcctcccaaagtgctgggattacaggcgtgaagcaccacgcccagcctgaaataatattttaccttttactttgtgctttttgtgttttactcaggaagtcctcccctacatctgttttcttctgtatttcttttcatatttaggtctttaatccacctggattttttgtttgggtttttgttgttctttagtcaaagatccaattcttttttctatttaaataaccatcattgactgactagtccatccttaccccacccctactgattatgatgtcactgctgtcacatattgtcatacgtggggggctgttactgggttctccagtctcctcccctttatctgtttgtgtatccctgtgctggtgccacactgcctcgttcactgatgtttttaataagcctgcaccatttgtatgtcaattcttcctgctcttcttatccatcaaaaatcactttaacttttcttgttcctttactcttccatataaattgtttattcaaccatcaggttccaggaaaaagcctgttagtattttcattggacttacatggaatttgtagattttgaaaaaacagatatttttatgagtcttcctattcataaaaatagtatgtctccatttacttatgtctttaagtgtatttcagtaaagctttctatcttttcacaaaataaaaaaaaaaactttagggggggcccggaccaaattcccct

SEQ ID NO: 736544 - DNA, 2564 bp, Homo sapiens
tgcgcgctgctcttccccgcggagcccgcgcagtccgcgcagccctcatcgcaactgggcccgcgcgcaggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaacgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcagtaagtttgttgttgaactgaaatgaatttcattatttcctccaatgtgtacttttgtgcccccctctcacttctccctatcatgacccctcttttgctgaaaaaaatttttattattttttctatctctagttctagaaagagaaaatttattttttaaattataaactattttgccaggcgccatggctcacacctctgcctcggcctcccaaagtgctgggattacaggcgtgaagcaccacgcccagcctgaaataatattttaccttttactttgtgctttttgtgttttactcaggaagtcctcccctacatctgttttcttctgtatttcttttcatatttaggtctttaatccacctggattttttgtttgggtttttgttgttctttagtcaaagatccaattcttttttctatttaaataaccatcattgactgactagtccatccttaccccacccctactgattatgatgtcactgctgtcacatattgtcatacgtggggggctgttactgggttctccagtctcctcccctttatctgtttgtgtatccctgtgctggtgccacactgcctcgttcactgatgtttttaataagcctgcaccttactacacaatcaagacgcctcggttattctcttcctctctct

SEQ ID NO: 736545 - DNA, 1978 bp, Homo sapiens
tgcgcgctgctcttccccgcggagcccgcgcagtccgcgcagccctcatcgcaactgggcccgcgcgcaggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaacgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccgttctccggcttcagactgcagaaggtgctgagggagtctgcgcgggacaaaatcattttcctacacgggaaggtaccaggaggcaaccctgaggtgggatgcgggaagc

SEQ ID NO: 736546 - DNA, 3323 bp, Homo sapiens
tgcgcgctgctcttccccgcggagcccgcgcagtccgcgcagccctcatcgcaactgggcccgcgcgcaggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaacgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccgttctccggcttcagactgcagaaggtgctgagggagtctgcgcgggacaaaatcattttcctacacgggaaggtgaatgaggcctctggggatggggatggagaggatgccgttgtgatcctggagaagacgccatttcaggtggaacaggtggctcagctcctgacgggcagccctgagctccaattgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaatattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactcaaaaaaaaaaaagaaaaaaagaagacgaaagcactaagagaggggcggcggccgccacctcagaggaagtctcccccgcgggggggggccaccaaccatgatgagacatctgacaccccaacgattcgtgtagagcacacgaagcggcgggcccccacacaaaatgaggaagggctgcgtaaataaatagaacacacggacatcccgagccgcgcgacgatataacagaaaccgagcccggcagacagggcggacaaccgcacgcgtgcacagcagggagagacagaacctggcggtggaaagcagcacacaaccaaacaaatgagctgggggggcgggggcgaaacaaccaaatcgtggggcgcaaacactcacctcacgagcagagaatgacatcagacagccgatcgcagcaggacgacgccaatac

SEQ ID NO: 736547 - DNA, 2878 bp, Homo sapiens
tgcgcgctgctcttccccgcggagcccgcgcagtccgcgcagccctcatcgcaactgggcccgcgcgcaggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaacgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccgttctccggcttcagactgcagaaggtgctgagggagtctgcgcgggacaaaatcattttcctacacgggaaggtgaatgaggcctctggggatggggatggagaggatgccgttgtgatcctggagaagacgccatttcaggtggaacaggtggctcagctcctgacgggcagccctgagctccaattgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaatattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttgtagcggggaacaatcacttatgttactttttcattattaaagt

SEQ ID NO: 736548 - DNA, 2800 bp, Homo sapiens
tgcgcgctgctcttccccgcggagcccgcgcagtccgcgcagccctcatcgcaactgggcccgcgcgcaggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaacgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccgttctccggcttcagactgcagaaggtgctgagggagtctgcgcgggacaaaatcattttcctacacgggaaggtgaatgaggcctctggggatggggatggagaggatgccgttgtgatcctggagaagacgccatttcaggtggaacaggtggctcagctcctgacgggcagccctgagctccaattgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaatattactttaccccacctggagtcccagagcctcagcatccagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactcaaagaagaacaaaaaaaaagc

SEQ ID NO: 736549 - DNA, 1679 bp, Homo sapiens; identical to SEQ ID NO: 125231

SEQ ID NO: 736550 - DNA, 771 bp, Homo sapiens
gtgagttacaaagtcctccggaatgagacggttctggaattcatgactgctctctgtcaaagaactggcttgtcctgtttcacccagacgtgtgagaagcagctaatagggctcattgtccttacaagatacaataacagaacctactccattgatgacattgactggtcagtgaagcccacacacacctttcagaagcgggatggcaccgagatcacctatgtggattactacaagcagcagtatgatattactgtatcggacctgaatcagcccatgcttgttagtctgttaaagaagaagagaaatgacaacagtgaggctcagctcgcccacctgatacctgagctctgctttctaacagggctgactgaccaggcaacatctgatttccagctgatgaaggctgtggctgaaaagacacgtctcagtccttcaggccggcagcagcgcctggccaggcttgtggacaacatccagaggaataccaatgctcgctttgaactagagacctggggactgcattttggaagccagatatctctgactggccggattgtgccttcagaaaaaatattaatgcaagaccacatatgtcaacctgtgtctgctgctgactggtccaaggatattcgaacttgcaagattttaaatgcacagtctttgaatacctggttgattttatgtagcgacagaactgaatatgttgccgagagctttctgaactgcttgagaagagttgcaggttccatgggatttaatgtggactac

SEQ ID NO: 736551 - DNA, 583 bp, Homo sapiens; identical to SEQ ID NO: 53475

SEQ ID NO: 736552 - DNA, 502 bp, Homo sapiens; identical to SEQ ID NO: 53474

SEQ ID NO: 736553 - DNA, 176 bp, Homo sapiens; identical to SEQ ID NO: 53467

SEQ ID NO: 736554 - DNA, 744 bp, Homo sapiens
ctggttattttgacgtgtgtttgtttggcggggggggttttaccttgtttactatggtttttataccatgaaaacgtttttattatttattaattaattaaagctgtcattttcttttcttttgctctactgattctactgtaggcagaaatagtatagtcatgtaaaatatatgttaaaatgtaaattaaatgtattttttaaaatatacacttaattctttgttgctataatgtgttcctcttctaggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggtaagtgagatccttacaataaaatataataatatttttaatttgagctgaaatttgaagaaatcagttggagtgggagctcatttatgttgacattgatgactttttggcctttattttattttattttttgtatttttcgtagagatggaattttgccatgttgcccaggctggtctcgaactcctgtgctcaggcagtccacccgcctcagcctcccaaaatgctaggattacaagccactatgcccggccataataccgattcgccggtacctgcata

SEQ ID NO: 736555 - DNA, 720 bp, Homo sapiens; identical to SEQ ID NO: 53466

SEQ ID NO: 736556 - DNA, 504 bp, Homo sapiens; identical to SEQ ID NO: 23703

SEQ ID NO: 736557 - DNA, 1040 bp, Homo sapiens
actagttctagatcgcgagcggccgtctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccggcttctgttttgtcgattgcttagatttgttcctgttgtcaaaactgttacccccaaaattggtgtgacacatgctcatgcataaaatgttaaaatgagtacatccttgtatttgtatttgttttcaacatcgccaaggtgctatgggaaattaacaaaattagaaaaaaaataaaattattaaaaagcaaaaaaaaaat

SEQ ID NO: 736558 - DNA, 7285 bp, Homo sapiens
gatgtaaaaattgaacctggatgattgatggggcaaaatacatttaatcaatttatacattttatttctgttttacagcatttatggggttaagtggcatgggatttctgtttctgatagtaaatagacgggctcactttgttaccccggctggagtgcggtgtcacgatctcggctcactgtaacctccacctcccaggttcaagcattcctcctgtctcagctctccaagtggctgggactacagtgagaatcagagcgtctactgcacctttcagatgaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggtaagtgagatccttacaataaaatataataatatttttaatttgagctgaaatttgaagaaatcagttggagtgggagctcatttatgttgacattgatgactttttggcctttattttattttattttttgtatttttcgtagagatggaattttgccatgttgcccaggctggtctcgaactcctgtgctcaggcagtccacccgcctcagcctcccaaaatgctaggattacaagccactatgcccggccactttttggcttttaaacagtgatatggatatctaattctccataccaaataaatgcatatgactaagaggtgagctattagagcgcataattttattccataaaatttgctgagtgaattgaaagaagagactggataacttttgcgtgattttaaatgcattttagtgttgcgaaatgtcagaccagacattctttactaagttatgaattgttcataaatccagtggtacttgaagtgaatattgcagaaatgaatcagtaaaatattttaagatatttttggcttgtaaaagataaattcataagctcattaaggttcttgtgaccctcacaccagattttacctttgccattaatattgtttaaacatacatttttttctaggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcagatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcatcggtcaaatggatttcagaggtttaaacttccctgtgattccccctgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaattttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaaagtgaatgtaaatggtggttaaaattacattactgtgaaattcatcttccaactctaagttaagctttggagatacatgttagtggttaactgttaagagctttgaaaacactgcacatatctgtacaagccagaattactatttctttgacttattattagcttggcagttgcttttgatttgattgttttatgacatggtatactactatatttactcagtttgaaactattcatttctacacactatttttaaaaattgcctactaggtgaaacataacaataaaactacctgtgctgaaatttgggggaagtttaggtcctttaaaaaaacatattaatcattgactacatctatgataaaagtgcttattttggtttactaagataatgcagttggtggaaatgataaacgttttaagtgttaacatcctttgaatgcgttggatttcagagaataaacattttgtaaaaatcacttggtaaggattataaacttaattactgcacttaaaatgaaacattactttttttaaacaatgtgtcacaaatgtaggtctgtattacttgtatgcttgtgtgacttactgttagtccagctctaaaaatttaaaggttgtaattgaaatacaagaaaagagccttcttttagaagaaagcaagtatatttttgcttttacttcaaatgttatttaaagtagaaatttaatttgtagatataacctttaaaaattttctcattaagacaatgtttttaatttaatttgcctcattacatctaatagttcccatttgatggcatgtatagggaagagtgagagagtgtgtgtgtgtgtatgtgtgtgtaatatttatatatattcacagtatgtatttagcatttattttattacagcagatttaaagtttgtatctaaataatgcctatgagttgtgtgaagctcttggcttttttccaacgttactttgtaactaatgagggtggatgttcattgtagtttatttatttggttctttagatggaggaatttaaaaaatcaaatttttctcttcacctttatgacttgacatttccttgatctgttggaggctaaaagtaggtataaatgatattgaatgttgggtatagtgatactctgccatagttcttactgcatgaagagaacaagagtcacacaagttcaccactttgcacttcatagagaaggtacatagagacattgcaaaacctgtctccatttgctatcctgataattaaggttttcataatacctagggcctgtctctgagtaattttaattttgccaaatacactgacatttaaaatagtgatccatctaaatttttttcagctgggttttgaggaatataagagctttcaatgataaaggtttgttgtagttgtcttatgtgctgaatttgcagatgatcagatgctgtgcagaattctgatttatttttgtttcctaaaattaagatagcttgaatattatttcacattcctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccggcttctgttttgtcgattgcttagatttgttcctgttgtcaaaactgttacccccaaaattggtgtgacacatgctcatgcataaaatgttaaaatgagtacatccttgtatttgtatttgttttcaacatcgccaaggtgctatgggaaattaacaaaattagaaaaaaaataaaattattaaaaagcaaaaaaaaaat

SEQ ID NO: 736559 - DNA, 1797 bp, Homo sapiens
gatgtaaaaattgaacctggatgattgatggggcaaaatacatttaatcaatttatacattttatttctgttttacagcatttatggggttaagtggcatgggatttctgtttctgatagtaaatagacgggctcactttgttaccccggctggagtgcggtgtcacgatctcggctcactgtaacctccacctcccaggttcaagcattcctcctgtctcagctctccaagtggctgggactacagtgagaatcagagcgtctactgcacctttcagatgaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacgtgatcttcataataattaaatgagcatttaattattggtatatggttatattaaataaatacgttattttcagaacatga

SEQ ID NO: 736560 - DNA, 6644 bp, Homo sapiens
gatgtaaaaattgaacctggatgattgatggggcaaaatacatttaatcaatttatacattttatttctgttttacagcatttatggggttaagtggcatgggatttctgtttctgatagtaaatagacgggctcactttgttaccccggctggagtgcggtgtcacgatctcggctcactgtaacctccacctcccaggttcaagcattcctcctgtctcagctctccaagtggctgggactacagtgagaatcagagcgtctactgcacctttcagatgaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcagatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcatcggtcaaatggatttcagaggtttaaacttccctgtgattccccctgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaattttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaaagtgaatgtaaatggtggttaaaattacattactgtgaaattcatcttccaactctaagttaagctttggagatacatgttagtggttaactgttaagagctttgaaaacactgcacatatctgtacaagccagaattactatttctttgacttattattagcttggcagttgcttttgatttgattgttttatgacatggtatactactatatttactcagtttgaaactattcatttctacacactatttttaaaaattgcctactaggtgaaacataacaataaaactacctgtgctgaaatttgggggaagtttaggtcctttaaaaaaacatattaatcattgactacatctatgataaaagtgcttattttggtttactaagataatgcagttggtggaaatgataaacgttttaagtgttaacatcctttgaatgcgttggatttcagagaataaacattttgtaaaaatcacttggtaaggattataaacttaattactgcacttaaaatgaaacattactttttttaaacaatgtgtcacaaatgtaggtctgtattacttgtatgcttgtgtgacttactgttagtccagctctaaaaatttaaaggttgtaattgaaatacaagaaaagagccttcttttagaagaaagcaagtatatttttgcttttacttcaaatgttatttaaagtagaaatttaatttgtagatataacctttaaaaattttctcattaagacaatgtttttaatttaatttgcctcattacatctaatagttcccatttgatggcatgtatagggaagagtgagagagtgtgtgtgtgtgtatgtgtgtgtaatatttatatatattcacagtatgtatttagcatttattttattacagcagatttaaagtttgtatctaaataatgcctatgagttgtgtgaagctcttggcttttttccaacgttactttgtaactaatgagggtggatgttcattgtagtttatttatttggttctttagatggaggaatttaaaaaatcaaatttttctcttcacctttatgacttgacatttccttgatctgttggaggctaaaagtaggtataaatgatattgaatgttgggtatagtgatactctgccatagttcttactgcatgaagagaacaagagtcacacaagttcaccactttgcacttcatagagaaggtacatagagacattgcaaaacctgtctccatttgctatcctgataattaaggttttcataatacctagggcctgtctctgagtaattttaattttgccaaatacactgacatttaaaatagtgatccatctaaatttttttcagctgggttttgaggaatataagagctttcaatgataaaggtttgttgtagttgtcttatgtgctgaatttgcagatgatcagatgctgtgcagaattctgatttatttttgtttcctaaaattaagatagcttgaatattatttcacattcctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccggcttctgttttgtcgattgcttagatttgttcctgttgtcaaaactgttacccccaaaattggtgtgacacatgctcatgcataaaatgttaaaatgagtacatccttgtatttgtatttgttttcaacatcgccaaggtgctatgggaaattaacaaaattagaaaaaaaataaaattattaaaaagcaaaaaaaaaat

SEQ ID NO: 736561 - DNA, 6428 bp, Homo sapiens
gatgtaaaaattgaacctggatgattgatggggcaaaatacatttaatcaatttatacattttatttctgttttacagcatttatggggttaagtggcatgggatttctgtttctgatagtaaatagacgggctcactttgttaccccggctggagtgcggtgtcacgatctcggctcactgtaacctccacctcccaggttcaagcattcctcctgtctcagctctccaagtggctgggactacagtgagaatcagagcgtctactgcacctttcagatgaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcagatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcatcggtcaaatggatttcagaggtttaaacttccctgtgattccccctgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaattttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaaagtgaatgtaaatggtggttaaaattacattactgtgaaattcatcttccaactctaagttaagctttggagatacatgttagtggttaactgttaagagctttgaaaacactgcacatatctgtacaagccagaattactatttctttgacttattattagcttggcagttgcttttgatttgattgttttatgacatggtatactactatatttactcagtttgaaactattcatttctacacactatttttaaaaattgcctactaggtgaaacataacaataaaactacctgtgctgaaatttgggggaagtttaggtcctttaaaaaaacatattaatcattgactacatctatgataaaagtgcttattttggtttactaagataatgcagttggtggaaatgataaacgttttaagtgttaacatcctttgaatgcgttggatttcagagaataaacattttgtaaaaatcacttggtaaggattataaacttaattactgcacttaaaatgaaacattactttttttaaacaatgtgtcacaaatgtaggtctgtattacttgtatgcttgtgtgacttactgttagtccagctctaaaaatttaaaggttgtaattgaaatacaagaaaagagccttcttttagaagaaagcaagtatatttttgcttttacttcaaatgttatttaaagtagaaatttaatttgtagatataacctttaaaaattttctcattaagacaatgtttttaatttaatttgcctcattacatctaatagttcccatttgatggcatgtatagggaagagtgagagagtgtgtgtgtgtgtatgtgtgtgtaatatttatatatattcacagtatgtatttagcatttattttattacagcagatttaaagtttgtatctaaataatgcctatgagttgtgtgaagctcttggcttttttccaacgttactttgtaactaatgagggtggatgttcattgtagtttatttatttggttctttagatggaggaatttaaaaaatcaaatttttctcttcacctttatgacttgacatttccttgatctgttggaggctaaaagtaggtataaatgatattgaatgttgggtatagtgatactctgccatagttcttactgcatgaagagaacaagagtcacacaagttcaccactttgcacttcatagagaaggtacatagagacattgcaaaacctgtctccatttgctatcctgataattaaggttttcataatacctagggcctgtctctgagtaattttaattttgccaaatacactgacatttaaaatagtgatccatctaaatttttttcagctgggttttgaggaatataagagctttcaatgataaaggtttgttgtagttgtcttatgtgctgaatttgcagatgatcagatgctgtgcagaattctgatttatttttgtttcctaaaattaagatagcttgaatattatttcacattcctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgatatggatattataaccatctgttatctaggctgtccatttaccggttggacactgatactctgtcaaattccttt

SEQ ID NO: 736562 - DNA, 2279 bp, Homo sapiens
gatgtaaaaattgaacctggatgattgatggggcaaaatacatttaatcaatttatacattttatttctgttttacagcatttatggggttaagtggcatgggatttctgtttctgatagtaaatagacgggctcactttgttaccccggctggagtgcggtgtcacgatctcggctcactgtaacctccacctcccaggttcaagcattcctcctgtctcagctctccaagtggctgggactacagtgagaatcagagcgtctactgcacctttcagatgaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggcatttaggtcgctcccatcattataaacaacgctgacatgaacatccttcagttaaattccttacgtgaaattattgtataataaataaagattgtaccagtgtactctaagcagtatatatga

SEQ ID NO: 736563 - DNA, 1651 bp, Homo sapiens
gatgtaaaaattgaacctggatgattgatggggcaaaatacatttaatcaatttatacattttatttctgttttacagcatttatggggttaagtggcatgggatttctgtttctgatagtaaatagacgggctcactttgttaccccggctggagtgcggtgtcacgatctcggctcactgtaacctccacctcccaggttcaagcattcctcctgtctcagctctccaagtggctgggactacagtgagaatcagagcgtctactgcacctttcagatgaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcttactccccaagggttttccaattacacgagaccgcacggtaggtaccggactttttacaaacagt

SEQ ID NO: 736564 - DNA, 1938 bp, Homo sapiens
gatgtaaaaattgaacctggatgattgatggggcaaaatacatttaatcaatttatacattttatttctgttttacagcatttatggggttaagtggcatgggatttctgtttctgatagtaaatagacgggctcactttgttaccccggctggagtgcggtgtcacgatctcggctcactgtaacctccacctcccaggttcaagcattcctcctgtctcagctctccaagtggctgggactacagtgagaatcagagcgtctactgcacctttcagatgaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatgagacggagttttgctgtgtcatccaggttggtctcttaactcctgagggcaagcgatccccccactaaggcctcccaaagtgttgggactatagacgtgagccactgcgcccagcatttgtgatgagtattttccatggatacagaatgcagggatgacagctaaaattattttccattcttttaagataccattctggactcttgtttctgatgagatgttcaccatcattcacatggttcttcccctgtatatgatgtgtcctttttctttgcctgctgtcaagatgttttatttttggtttccagtaggttggctatggtgtgtctagtatgcttttacttattatacttgggaaatactaaacttcttggctctgtatgttgatattctttactgcatttggggaatttccaaatacttgccaaaaattttttctgccctctcttctcctttctttttttggtactccaatttcatatgttggactgattgatgtcactgagattctgttcatttttcttcaacctatttttgttgttgttgttgttctccagattggatcatttctgtggatttgggttcatcttcaagttcactgaacttttcttttgctgtccccaatgtgataggactgtccagtgaatattttagatgctgtattctagagtttccatttttcaaaatatttcttctctctctgctgtgatttccccttaatttcaatttattagaaacataaatgttatccatgaatatatgtacttgtaagagctgtattaaaactttgtctgcagtctgacatctgggtcatct

SEQ ID NO: 736565 - DNA, 815 bp, Homo sapiens
  misc_feature (796)..(796): n is a, c, g, or t
gatgtaaaaattgaacctggatgattgatggggcaaaatacatttaatcaatttatacattttatttctgttttacagcatttatggggttaagtggcatgggatttctgtttctgatagtaaatagacgggctcactttgttaccccggctggagtgcggtgtcacgatctcggctcactgtaacctccacctcccaggttcaagcattcctcctgtctcagctctccaagtggctgggactacagtgagaatcagagcgtctactgcacctttcagatgaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacaggccaccttnagaaatggggatcctcaga

SEQ ID NO: 736566 - DNA, 1227 bp, Homo sapiens
tgaatgtgtgatcaatgagcaagaactgaaaagtctctgttctaggtaggatcgagaacttctttttttctaattccacacagacacatcttcggcctctgaggatgagggctctctgagacgccaagctgcgctctctgctgccttgcaacagagcttacagaatgctgagtcctggatcaaccgttcaattcagggatcgtccacttcttcatccgcatcttctacgctgtcccacggagaggtcaaaggaaccagtgggtctctagctgatgtatttgccaatactcgaataggtaggagctggatctacccaagaagcccaaattacattccatttggctcccagtatccaggaaatagtttatggtttgtgttaggtttttcagtatggcctgaagccatagctatttccataagcaatgctcaagctgcaagatataacaccagtctcagtgtggagttatcccagctgaagaatattcgatctggatttttgttaacaagatgtctcatccaaccgtatatttttcattgcttctactactctgtgaaaagttactggttcagttactcacagaaaccattttatccacattattgctttttggatgtttgttgtaacaggagtaattcatgatcctaatagaaaaattcaaaaatataggtaaaagaaaagtaaaataacctataatcctacctcccatgggtaatactttagtattattactgtagtgtatattcttctagattttacttacatatgtaaggttttggttttgattttacaaaaatgaactgtcctaaacataatgttaataacctgcttttcttagcagtatgtgatgaacatcttttacatcattatgttacactattatttttatggtttcaatatacactattgtgtgactctctgccctggtttatttggccattcccctattaaatagtgtccaattttttgctattataaaaattattggattgaacatgcttgaacacacaactttgtacatttgtctgattatttccttagcgtatattcctataagtttgaattgctggaccaaataaaaatgtctgttttaatgctttttgttaccacattatcctacagaaaggtataccggaatatactcatgttagtatatttaaaattttaaaaactattcaactaataattacagacttaaggggcatagagaccttacccccaaatctatt

SEQ ID NO: 736567 - DNA, 1589 bp, Homo sapiens
aaactgattcagcagtacagaaagaacttagaaaccagacacctgctccatctgcagctcaaacttctgctccctctaagtaccaccgaactcgatctgggggagccagggatgaacgatatcgatcagatatccacacagaagcagttcaggctgcactggcaaagcataaagaacagaagatggctttgcccatgccaaccaaaaggcgatccacatttgttcagtctcctgcagatgcctgcacacctcctgacacatcttcggcctctgaggatgagggctctctgagacgccaagctgcgctctctgctgccttgcaacagagcttacagaatgctgagtcctggatcaaccgttcaattcagggatcgtccacttcttcatccgcatcttctacgctgtcccacggagaggtcaaaggaaccagtgggtctctagctgatgtatttgccaatactcgaatagagaatttctctgctcctcctgatgtcactacaactacctcttcctcctcatcatcttcctcaattcgcccagcaaacattgacctgcccccctcggggatagttaaaggcatgcacaaaggatccaacaggtccagccttatggatacagctgatggtgttcctgtcagtagcagagtatctacaaaaatccagcagcttctgaacactctgaaacgacccaaaaggcctcccttaaaggaattttttgtggatgactctgaagaaattgtggaagtacctcagccagaccccaaccagcccaagccggagggacggcagatgacccctgtgaaaggagagcctttaggagtcatctgtaactggcctcctgctcttgaatctgccctgcagcgctggggtaccactcaagcaaaatgctcctgtctgactgcactggacatgacagggaaaccagtttacactcttacatatggaaagttgtggagcagaagtttaaagttggcctacacacttcttaataaactggggaccaaaaatgaacctgtgttaaaacctggagacagggtagccctggtttaccccaacaatgatccagtcatgtttatggtggctttctatggatgcctcctggcagaagtgattccagtgcctatagaggtacctcttaccagaaaggatgctggaggtcagcagattggcttcttgctaggaagctgtggtattgccttagctcttaccagtgaagtttgtctaaaaggactgccaaaaacccagaatggagaaattgtacagtttaaaggttggccccggctcaaatgggttgtaacagattccaagtacctttcaaagccaccgaaagactggcagccacacatctcacctgctgggacagaaccggcatacattgaggtaagtcctaagatgtaaaatatgctttcaggcttttccttgggctttgcttgccacctttcaaaatataaaactgaatttttgcaacgttaatgttagaagatcctcctgctttgtgagatttccatcttttggcttgtaaaatgccttgtagtggatcttctatcctaattattttgatcataagtatacattcaagagaatgacagc

SEQ ID NO: 736568 - DNA, 1488 bp, Homo sapiens
aaactgattcagcagtacagaaagaacttagaaaccagacacctgctccatctgcagctcaaacttctgctccctctaagtaccaccgaactcgatctgggggagccagggatgaacgatatcgatcagatatccacacagaagcagttcaggctgcactggcaaagcataaagaacagaagatggctttgcccatgccaaccaaaaggcgatccacatttgttcagtctcctgcagatgcctgcacacctcctgacacatcttcggcctctgaggatgagggctctctgagacgccaagctgcgctctctgctgccttgcaacagagcttacagaatgctgagtcctggatcaaccgttcaattcagggatcgtccacttcttcatccgcatcttctacgctgtcccacggagaggtcaaaggaaccagtgggtctctagctgatgtatttgccaatactcgaatagagaatttctctgctcctcctgatgtcactacaactacctcttcctcctcatcatcttcctcaattcgcccagcaaacattgacctgcccccctcggggatagttaaaggcatgcacaaaggatccaacaggtccagccttatggatacagctgatggtgttcctgtcagtagcagagtatctacaaaaatccagcagcttctgaacactctgaaacgacccaaaaggcctcccttaaaggaattttttgtggatgactctgaagaaattgtggaagtacctcagccagaccccaaccagcccaagccggagggacggcagatgacccctgtgaaaggagagcctttaggagtcatctgtaactggcctcctgctcttgaatctgccctgcagcgctggggtaccactcaagcaaaatgctcctgtctgactgcactggacatgacagggaaaccagtttacactcttacatatggaaagttgtggagcagaagtttaaagttggcctacacacttcttaataaactggggaccaaaaatgaacctgtgttaaaacctggagacagggtagccctggtttaccccaacaatgatccagtcatgtttatggtggctttctatggatgcctcctggcagaagtgattccagtgcctatagaggtacctcttaccagaaaggatgctggaggtcagcagattggcttcttgctaggaagctgtggtattgccttagctcttaccagtgaagtttgtctaaaaggactgccaaaaacccagaatggagaaattgtacagtttaaaggttggccccggctcaaatgggttgtaacagattccaagtacctttcaaagccaccgaaagactggcagccacacatctcacctgctgggacagaaccggcatacattgagtataaaacaagcaaagaagggagtgtaatgggagttacagtatcccggcttgcaatgttgtctcactgccaagctctgtcgcaggcctgcaattattctgaaggtcaga

SEQ ID NO: 736569 - DNA, 1360 bp, Homo sapiens
cggcgggaggcgcggggcggaacagatcgcagacctgggggttcgcagagcgtgagtctgatcccccagacccaattctaccgcacccggctctgcaaggccaggggagggccgcctccacccatacaagtcccgggtttccctcccgccccggggagggcggcgattccacccccagggctgcgggaggcctggagggtcttccggggctagctgtgcgcgcgcccaccttccttgggagccgaggggtcagccgagtggtgctggggcaggaggcttgctcctcccctaaaccaggcggagtgctttgtctcttcagctctgcctcctgtcagcactaactgcattattctgcccagtgtagtcggccggttccttattatctgcgtgaacttagccatttacttaacctctctgtttcagcgtattcataccccgtgcccaccccatcacctcatgatgcccccgcctctttcgctctgctccagtccgtctggcctcgctgttgctggagaggccaggtcctgcctcagtgcttttggcttggctgtttcgtttgccacggatgtctttctttccccagatatcaacatggcttgctggtcattcgcttcaggtcttcaagtcttgggtcaaatggtggcttctcagtgaagtcttatttgaccacactaaaaattgcaccatctcacccccattgtccttttcttgctcgattttgtttttaccccatagcacttaacaccttacaacaagctatatattttgcttatttcagtcattcatttaataactattcgcacctatttgtgtgccaggctatgtgtgcccccactgcatgggggcaaacatctctgcccttgtggagcttccattctaaggggggagataataaacacatttataagtaagagagtatgtcagataagtgtatcatctcctgtcacagtgagttaaaatctggtgtttaatctccatgattagactgagcttcctaaaactggagtggtagctgattttcacctccttgtccctgatatcttgagggagatcaggatctctcaggcccttcctgctcaaaacataggacacacttgacttttctgatatcctttcagcgccagtggggagatgttgaagttcaaatatggagcgcggaatcctttggatgctggtgctgctgaacccattgccagccgggcctccaggctgaatctgttcttccaggtaacagcctaccctgccaactttgctcacctgtgtgtgtccttggaatctccttgtcactcacctttgcttttatttatttgtttatttatttagagtctcagtcctgggcgacaagagcgagactctctca

SEQ ID NO: 736570 - DNA, 3298 bp, Homo sapiens
  misc_feature (3298)..(3298): n is a, c, g, or t
tgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttccttttttttttttttttttaagacaacagaattcttaatagatttgaatagcgacgtatttcccgtgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 736571 - DNA, 449 bp, Homo sapiens
taaaaagtccctcatttttaataaagctgagagctggctcagcagagggcctctggttttcacagtcagtcccatctggccaggggtccctgggctctgctcctcattcttccatcaccatgtgtgtcgctgatgcccctgctcttggctgtgctaatgcccacgtgctcttgacaccttgcagaatttggagtgttcgtggattcttacggaagacgtagccgcacagacgatctcaagtggagtcgcttacctttggcctttggtacgtgaggctcagtgtgggggcttctcttttgccagcagctggtgtcgtatctgtgtgaatgttctgaaatgccgtcgtggcccagatacccttcgaggctattttgtttctctcttgctgcataacaagccatctgaaagcttagtgacttcaaacaacagcttattattggccccaactc

SEQ ID NO: 736572 - DNA, 3244 bp, Homo sapiens
  misc_feature (3244)..(3244): n is a, c, g, or t
acatcgcaggctgtacgcgccggatgttacggatcagcaggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttccttttttttttttttttttaagacaacagaattcttaatagatttgaatagcgacgtatttcccgtgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 736573 - DNA, 2501 bp, Homo sapiens
  misc_feature (2501)..(2501): n is a, c, g, or t
atcgagctcggtaccgtcgtgtctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttccttttttttttttttttttaagacaacagaattcttaatagatttgaatagcgacgtatttcccgtgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 736574 - DNA, 2021 bp, Homo sapiens
  misc_feature (2021)..(2021): n is a, c, g, or t
ggtggaccggtccggaattcttgcgatagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 736575 - DNA, 1872 bp, Homo sapiens
  misc_feature (1872)..(1872): n is a, c, g, or t
ggcccctgtgacgtcgtgaacttagggatcagatcacgtaatcaacgctctgggatcgctgcaacctggcacttcaaggtaagtgcaccgataacgtctagaccggcaaacacagatctagaggtggccaactgatcactgtaggagctgactggcaaagtcaaccaggcccaaccaagagtgaccaagacaacgattaggataacccacaggcactcctcgtcataaggccaacgacacagacaggctggcaaataaagggtttaatcctaagttcagagccaggcctggctctgcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 736576 - DNA, 1168 bp, Homo sapiens; identical to SEQ ID NO: 353976
  misc_feature (54)..(54): n is a, c, g, or t
  misc_feature (1168)..(1168): n is a, c, g, or t

SEQ ID NO: 736577 - DNA, 1699 bp, Homo sapiens
cggcgggaggcgcggggcggaacagatcgcagacctgggggttcgcagagcgtgagtctgatcccccagacccaattctaccgcacccggctctgcaaggccaggggagggccgcctccacccatacaagtcccgggtttccctcccgccccggggagggcggcgattccacccccagggctgcgggaggcctggagggtcttccggggctagctgtgcgcgcgcccaccttccttgggagccgaggggtcagccgagtggtgctggggcaggaggcttgctcctcccctaaaccaggcggagtgctttgtctcttcagctctgcctcctgtcagcactaactgcattattctgcccagtgtagtcggccggttccttattatctgcgtgaacttagccatttacttaacctctctgtttcagcgtattcataccccgtgcccaccccatcacctcatgatgcccccgcctctttcgctctgctccagtccgtctggcctcgctgttgctggagaggccaggtcctgcctcagtgcttttggcttggctgtttcgtttgccacggatgtctttctttccccagatatcaacatggcttgctggtcattcgcttcaggtcttcaagtcttgggtcaaatggtggcttctcagtgaagtcttatttgaccacactaaaaattgcaccatctcacccccattgtccttttcttgctcgattttgtttttaccccatagcacttaacaccttacaacaagctatatattttgcttatttcagtcattcatttaataactattcgcacctatttgtgtgccaggctatgtgtgcccccactgcatgggggcaaacatctctgcccttgtggagcttccattctaaggggggagataataaacacatttataagtaagagagtatgtcagataagtgtatcatctcctgtcacagtgagttaaaatctggtgtttaatctccatgattagactgagcttcctaaaactggagtggtagctgattttcacctccttgtccctgatatcttgagggagatcaggatctctcaggcccttcctgctcaaaacataggacacacttgacttttctgatatcctttcagcgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatg

SEQ ID NO: 736578 - DNA, 5709 bp, Homo sapiens
  misc_feature (5709)..(5709): n is a, c, g, or t
cggcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttccttttttttttttttttttaagacaacagaattcttaatagatttgaatagcgacgtatttcccgtgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 736579 - DNA, 2296 bp, Homo sapiens
tgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaagtaaggagggttaacaaggt

SEQ ID NO: 736580 - DNA, 4270 bp, Homo sapiens
tgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctgtgagtatgaaagcgggccctggaggttgtctttgtaaagggggctgacttggtaactggtgttaacgacgagaatcccattggccattttgattcccctcaggctctctctctgagggctgatggctctagactgtgtcatggccaggagtctggtggtgatgaaggcacaagcaccaaggtagcttgtgtggcatcatgatccatttagaatgtgggaatcagggatgcggtggctcatgcctgtggtcccagtgacccaggaggccaaggcaggaggatcacttgagcccaggagtttgaaaccagactgggcaagatagcaagatcccatctcttaa

SEQ ID NO: 736581 - DNA, 7981 bp, Homo sapiens
  misc_feature (7981)..(7981): n is a, c, g, or t
tgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttccttttttttttttttttttaagacaacagaattcttaatagatttgaatagcgacgtatttcccgtgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 736582 - DNA, 4639 bp, Homo sapiens
tgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataacacgttcgcgagagataacacgttcgcgagggataacacgttcgcgagagataacacgttcgcgagggataacacgttcgcgagagataacacgttcgcgagggataacacgttcgcgagagataacacgttcgcgag

SEQ ID NO: 736583 - DNA, 3950 bp, Homo sapiens
  misc_feature (3950)..(3950): n is a, c, g, or t
gatcactgttcatcctgagaggcatgaaaggtgaatggggcgtgtgcagtggctcaagcttgtaattctaatgctttgggaggctgaggtgggaggattgcttgagcccagcagtttgaggctgcagtgagctatgatcacaccactgcactctaacctaggtgacagagcgagatcttgtctccaaaaaaaaaaaaagatgaatggctctctatgacaacgtgaacaagcttggtgacaatgttctccagggcttggctagatgctgtaggcagaagcagaacagctgtggaccttggctgccctgtgttacctctcacatccttctcttctgctctcatgtctcaggagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttccttttttttttttttttttaagacaacagaattcttaatagatttgaatagcgacgtatttcccgtgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 736584 - DNA, 7363 bp, Homo sapiens
  misc_feature (7363)..(7363): n is a, c, g, or t
ggatcccctctggatgaaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttccttttttttttttttttttaagacaacagaattcttaatagatttgaatagcgacgtatttcccgtgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 736585 - DNA, 5696 bp, Homo sapiens
  misc_feature (5696)..(5696): n is a, c, g, or t
atgcatgtagtcgcagtcagcgttgattattatttactcgctggcatgtcagtatattactccgttagcagctttcctccgttaaactggttcttgctttttcccttgtttcaaacttagaaataatttccatcctcatataataacctatggaagactcaccagtgacagggacttctgtatttagaaaaaagcaacctttacgttctgacctttagaactcaatattctttctccgtgaaggttcgtggacattcataaacgttgtcagcatctaacattcctaagtgtggcattatgccaatctttccaaatgtctagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttccttttttttttttttttttaagacaacagaattcttaatagatttgaatagcgacgtatttcccgtgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 736586 - DNA, 5348 bp, Homo sapiens
  misc_feature (5348)..(5348): n is a, c, g, or t
cgagctagaggatccagaggctgagtggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaagggtttatttagtcgacggaaagaggaccctgctttacccacacaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttccttttttttttttttttttaagacaacagaattcttaatagatttgaatagcgacgtatttcccgtgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 736587 - DNA, 4579 bp, Homo sapiens
  misc_feature (4579)..(4579): n is a, c, g, or t
ttcctggaagttgtcccccaccaggtgcaacacgcttgtctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttccttttttttttttttttttaagacaacagaattcttaatagatttgaatagcgacgtatttcccgtgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 736588 - DNA, 1224 bp, Homo sapiens
  misc_feature (9)..(9): n is a, c, g, or t
gcggccgcncccacttcagataatgacaaagcaagggaaggagacaaacaaagagaaggaacaatttaagggacaagaagagaaaggggagaacaaggacagcaccttgacaaggaccccgctcgagccgctggagaaaaacaagcaaatcctagtgctgggcctggatggagcaggaaaaaccagtgtcctgcactctctagcttcaaacagagtccagcacagtgtggcacccacccaaggtttccatgcagtttgcatcaacactgaagacagccagatggagttcctggagattggtggcagtaaaccttttcggtcctactgggaaatgtacctatccaagggattgctgctgatctttgtggtggattcagcagatcacagccgattacctgaagccaagaaataccttcatcagctaattgcagcaaacccagtacttcctctggttgtgtttgcaaacaaacaggatcttgaagcagcctatcacattacagatatccatgaagctttggcattatctgaagtgggaaatgacaggaagatgttcttgtttggaacctacctgactaagaatggctcagagataccctccaccatgcaagatgccaaagacttgattgcacagctggctgcagatgtgcagtgaccaggactcagcccactgtgcggctcacgactgagatgtcatcagtgttgaatggcaggcttgaagccaaaggtttccacctcaaataaaaattaagccatttcctattttctcagtgcatgggatgtatatagttagccctccatatccatgggttccacatctggggattcaagaactgtggatccaaaacattcaaaaagtaaacccactgaagaataataacacaacaataaaaataatacacattttaaaatacaatataacaactatttacatagcattttcattgtattaggtattataagtaatctaaagatgatttaaaatacacgagtagaagtgtgtaggttatatgtaaatatgccattttccatcaggagcttgagcatccacatttgcctgtgaggatcttggaatcagtctccctgagaataccaacggacaactgtacaaagataatgctaacataataacagcatctctatttggattttgaatgttaaaaatatttgtaaaacagtgtattgggggtattgggatttttaatcaacaaaggtaaaatgaacatt

SEQ ID NO: 736589 - DNA, 1258 bp, Homo sapiens
agctgagggaaggctgagaatcctcccggaacctctggattctgacgccccaggggttcttcacacaggctggccggtctcgggattgaagccggagacgtcagacgctaaggttgcttagactgcggcccacgtggaaggctcttagccaccctgcctggcccgaggagaaaaacaagcaaatcctagtgctgggcctggatggagcaggaaaaaccagtgtcctgcactctctagcttcaaacagagtccagcacagtgtggcacccacccaaggtttccatgcagtttgcatcaacactgaagacagccagatggagttcctggagattggtggcagtaaaccttttcggtcctactgggaaatgtacctatccaagggattgctgctgatctttgtggtggattcagcagatcacagccgattacctgaagccaagaaataccttcatcagctaattgcagcaaacccagtacttcctctggttgtgtttgcaaacaaacaggatcttgaagcagcctatcacattacagatatccatgaagctttggcattatctgaagtgggaaatgacaggaagatgttcttgtttggaacctacctgactaagaatggctcagagataccctccaccatgcaagatgccaaagacttgattgcacagctggctgcagatgtgcagtgaccaggactcagcccactgtgcggctcacgactgagatgtcatcagtgttgaatggcaggcttgaagccaaaggtttccacctcaaataaaaattaagccatttcctattttctcagtgcatgggatgtatatagttagccctccatatccatgggttccacatctggggattcaagaactgtggatccaaaacattcaaaaagtaaacccactgaagaataataacacaacaataaaaataatacacattttaaaatacaatataacaactatttacatagcattttcattgtattaggtattataagtaatctaaagatgatttaaaatacacgagtagaagtgtgtaggttatatgtaaatatgccattttccatcaggagcttgagcatccacatttgcctgtgaggatcttggaatcagtctccctgagaataccaacggacaactgtacaaagataatgctaacataataacagcatctctatttggattttgaatgttaaaaatatttgtaaaacagtgtattgggggtattgggatttttaatcaacaaaggtaaaatgaacatt

SEQ ID NO: 736590 - DNA, 974 bp, Homo sapiens
  misc_feature (850)..(850): n is a, c, g, or t
cagctctgtgctgattagtaatgatgtgtttaatgaaatttcaaggttcattacggaatgtggattaattaaattgagagggaagataatgaaaaatattcccattggatacataaaagagcaggcctgctgtggtgggaggagggagttgaaatgtatggacctgccagaactctccaagtctgcccctggaaaatgagccaagtctttctgctgcgtcctctaagcaaagacggtggcctgagtccatgtgggagcccagtggggcctctgagtctcacttgtgatttggggagagtcatactggctccctgctgggctcagcatcacattcaaagtcactggttcatgtcctcccaggaccttggagttggccaagcactcatgaatccctctgtgtactttctttaccaagggttctggaaggaaaggaatgaaaacatacacatcagattcatccagatgcaccaatctcagcagccaggcagcagcaggaggaggcgcagcagtgtctgacagctctgaagtttccgcctggttcaggaatcctggaagttttcccagagtcctctgcgcatgctggaaaaatctgctttgaacttcctgatgagccagttggagcatgaaggatctggttgagtcttaaaagccttaatactgaggcttaaattccagtgtctgtgtgagttaggattgcgggttactgagcaccctcggctgaagaacaatcatgctcatcccgtgtgtctgcaagcccacctctccctgcctcttgtgccttccccagcccaatccccagcagaactctatccgtaagggctattgtgcccatttcatggaaacacacagntggcaagcagctgctacacccaccacagataaatctcataaacaaaacgctaagtgaaaaccactagagttaagagaatatgcaatgtgtgatgccattcacccaaagcgggttcaactgttca

SEQ ID NO: 736591 - DNA, 1544 bp, Homo sapiens
tcagttaattagtaagaggaagcagaaatatcaagggacttaagaattggcaggcatgagccaccactcccggccttaactattcttttggagttaatgtttgcactgatgactttgttttatattagtatattacttagtaatacagtattaggtaaaaagattatagatccttaatgatctgtgaagggaaaggtgttttctggttaggaatttaggcagttgccatatttgtgaaaatgttcacaaagtcataattaaaaacctcggatgtggagttgagctgttttggagttaactttgaatgatattgataattggtttaagacttggtttaggaaatgggaagtgcactagtttatattacagaatatatagataattgtgagttgtaatatgacatttgacatcacttcatgactagtttttcagatcctgaaattgggctgcactgtgaaataattctaaaatttaggtaattgctgtttggtggtgaagatacttggcaagaagaccacttttacttgagtttcagactttaatctgagtttagacttagttattatagatgtaaataccaaaacggttgataatagatggatcatcctagagaaaaattttaaaaatatgaatatccaagtccacttaggtacctttctcattctcttactatatctgttctcatgaacaagcagtcactaagatggacctgactcactctgaattcagttttgaaggcaaacctttttggggcttgcatggcttggctctccatttttcagtcttggggtcaaaatacctctgattgtgtccctcagttctgggcagatttcctctgtctttgctgttcatactgttaaaccaaagcagtcattttcttatctacctctcctgatcagttaagcaggtttgtgctgttttttcaaactgttcctttactctcagattctattagaattaaagaagcaagaatagaaccaattgtatatataggttctgttgtgagattataacactccataaccaaattgcctgcaatcagaagtcttactttcattacaggtagaaatagcttatatcatttgaaattttatctctcttagttttgtaatttcctattaccttacttaggtcattttaaaaagtctacttgtttaaccattttggaattgttgatttaaaggggctataatccataaacaaaataatttttgttttataaaactattgtcttataagattttaatacatttaagagggtttcatgtcgcctgggaatatagttcaagattttaaaacctcttttgaacaaagggtactatcgaatgtgaaagttgatgaaaaacagactaaaagttttgaatgactgctcactaaaattttattgcttaatgtatttgtagccttatgtctttttggaaaatataataacattattatgaaggtaatgtttaatcatttctcaatactttccagatagaatttttgtagaacttttagcttaagtttctttttttaacataataaattctgctttgattgtc

SEQ ID NO: 736592 - DNA, 1623 bp, Homo sapiens
atgtgacaccacgcccggctaattttgtatttttagtagagatggggttttaccatgttggtcaggctggtatcaaagtcctgacctcaggtaatccacccacctcggcctcccgaagtgttgggattacaggcatgagccaccactcccggccttaactattcttttggagttaatgtttgcactgatgactttgttttatattagtatattacttagtaatacagtattaggtaaaaagattatagatccttaatgatctgtgaagggaaaggtgttttctggttaggaatttaggcagttgccatatttgtgaaaatgttcacaaagtcataattaaaaacctcggatgtggagttgagctgttttggagttaactttgaatgatattgataattggtttaagacttggtttaggaaatgggaagtgcactagtttatattacagaatatatagataattgtgagttgtaatatgacatttgacatcacttcatgactagtttttcagatcctgaaattgggctgcactgtgaaataattctaaaatttaggtaattgctgtttggtggtgaagatacttggcaagaagaccacttttacttgagtttcagactttaatctgagtttagacttagttattatagatgtaaataccaaaacggttgataatagatggatcatcctagagaaaaattttaaaaatatgaatatccaagtccacttaggtacctttctcattctcttactatatctgttctcatgaacaagcagtcactaagatggacctgactcactctgaattcagttttgaaggcaaacctttttggggcttgcatggcttggctctccatttttcagtcttggggtcaaaatacctctgattgtgtccctcagttctgggcagatttcctctgtctttgctgttcatactgttaaaccaaagcagtcattttcttatctacctctcctgatcagttaagcaggtttgtgctgttttttcaaactgttcctttactctcagattctattagaattaaagaagcaagaatagaaccaattgtatatataggttctgttgtgagattataacactccataaccaaattgcctgcaatcagaagtcttactttcattacaggtagaaatagcttatatcatttgaaattttatctctcttagttttgtaatttcctattaccttacttaggtcattttaaaaagtctacttgtttaaccattttggaattgttgatttaaaggggctataatccataaacaaaataatttttgttttataaaactattgtcttataagattttaatacatttaagagggtttcatgtcgcctgggaatatagttcaagattttaaaacctcttttgaacaaagggtactatcgaatgtgaaagttgatgaaaaacagactaaaagttttgaatgactgctcactaaaattttattgcttaatgtatttgtagccttatgtctttttggaaaatataataacattattatgaaggtaatgtttaatcatttctcaatactttccagatagaatttttgtagaacttttagcttaagtttctttttttaacataataaattctgctttgattgtc

SEQ ID NO: 736593 - DNA, 570 bp, Homo sapiens
  misc_feature (549)..(549): n is a, c, g, or t
tccttaagttggagacttgtgctccaagctctgaaagagttaattcccttttctactctgtgccaacggaaatggatgtcactgcttaccttgtagagcttcagggccgcctcgtgcctgtgattggtggtatgcaagcgtaatttatccacactgttggtgtaatagtcacaggcgttacattttaggtgaacagggttgccaatggcaatacacttcaacctccactcattgcttttgcccccttctttaatgtgagccaccagttgatatttctgcatatgtttatcagtcttgcagtgtagctggaagttggctttgagctgagtgttgtagttgcagagcttgcactggtagatatctccaattactgccctccattcctcttcagggagagagcgctcactgctcacatgcacacttagggcctccaggctgtcagaggtgaatttgttgcaaacagcacactggaatagcttcagcgctgggtcactgatataaggtgacagctctcctgcagtaaggagggacaggtcatcacccattagntgaccactggcaagccggatt

SEQ ID NO: 736594 - DNA, 1146 bp, Homo sapiens
gatctctgctgcctgcattgagggctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttagggtaattgcattttattttattttttgatgctgaacatacaatgctgtagcatgcacataccagtcccagtaatttactgtcaaatcatttttgctgagtgatgcaaattactgatcaattggttatcttaattcacattttgatttgacagagtcctattgcatgcaatattttcttctaaatgggaaattataggtaatttttgttttcaaaaatattgtttttattcacagtaaaaatacattaggactttcaattgctgaaataaagaagggttttattttttaat

SEQ ID NO: 736595 - DNA, 4989 bp, Homo sapiens
  misc_feature (2322)..(2322): n is a, c, g, or t
  misc_feature (3162)..(3162): n is a, c, g, or t
gatctctgctgcctgcattgagggctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtattttcttacactgctgacaaagaaatccgaaccgatgacttgtgcttggatgtttctagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatctttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctccnagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttanatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttccaaaaactttgtcttcaaattttaattttcttcctaatattcttcacattaaactatggactctaattttctggataaaatatcctgccttatggaaatgaaatatgaaattttattaaaatgctgctatattacataagttgc

SEQ ID NO: 736596 - DNA, 3750 bp, Homo sapiens
  misc_feature (26)..(26): n is a, c, g, or t
  misc_feature (38)..(38): n is a, c, g, or t
  misc_feature (1083)..(1083): n is a, c, g, or t
  misc_feature (1923)..(1923): n is a, c, g, or t
cctagctggagacgactctctaattnccaccgctacangtattttcttacactgctgacaaagaaatccgaaccgatgacttgtgcttggatgtttctagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatctttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctccnagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttanatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttccaaaaactttgtcttcaaattttaattttcttcctaatattcttcacattaaactatggactctaattttctggataaaatatcctgccttatggaaatgaaatatgaaattttattaaaatgctgctatattacataagttgc

SEQ ID NO: 736597 - DNA, 3953 bp, Homo sapiens
  misc_feature (1286)..(1286): n is a, c, g, or t
  misc_feature (2126)..(2126): n is a, c, g, or t
agaaccccccttgggtagtacagatcacaacccagaggtttcagtattttcttacactgctgacaaagaaatccgaaccgatgacttgtgcttggatgtttctagactcaatggacctgtaatcatgttaaaatgccaccatatgagaggaaatcagttatgggaatatgatgctgagacccacactcttcttcatataatcacccagtcttgtctctcagtgaacaaagtagctgatggctcccagcatcctactgtggaaacctgtaatgatagcactttgcaaaaatggctactaagaaactatacaagaatggaaatttttagaaatatttttgggaattctactgattacattctctaatgatttttggagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatctttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctccnagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttanatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttccaaaaactttgtcttcaaattttaattttcttcctaatattcttcacattaaactatggactctaattttctggataaaatatcctgccttatggaaatgaaatatgaaattttattaaaatgctgctatattacataagttgc

SEQ ID NO: 736598 - DNA, 4278 bp, Homo sapiens
  misc_feature (1611)..(1611): n is a, c, g, or t
  misc_feature (2451)..(2451): n is a, c, g, or t
ggctgactagaggacccttacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtattttcttacactgctgacaaagaaatccgaaccgatgacttgtgcttggatgtttctagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatctttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctccnagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttanatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttccaaaaactttgtcttcaaattttaattttcttcctaatattcttcacattaaactatggactctaattttctggataaaatatcctgccttatggaaatgaaatatgaaattttattaaaatgctgctatattacataagttgc

SEQ ID NO: 736599 - DNA, 453 bp, Homo sapiens
tttgtatttccaatggttcctttattttcaaaattcttaaaagtacttgtaatcactgattcattcaacaatcatttattaacacctaataggtgctaggaacttttctaggtgctagggatccaacagggaaaaattccctacattacattccagccaattatgttctgctcttaacagcaaggtgactggttaaaaattgaacgaacaaacactgattaataacctctaaagatcgagagccttccatctggttcactgctatttttcaatttgctaatctctgccccctaagaggctgatacctctccctttccagaatggggaatagactggtgtaatgggtgaagtctgggaaccgcgggtcaggagacggagctgtgtcacaaaaagtagcttcttggtaaattacttgatcagggtattttacttcaaaatacaagtgtgatcatg

SEQ ID NO: 736600 - DNA, 1119 bp, Homo sapiens
cccaaccaatcagagctcttgactcactggcttccccctacccaccaagttgtccttaaaaactttgatccccgaatgcttggggaaaccaatctgagtaataataaaactcaagtcacctgcacagctggctctgtgtgaattactctctctattgcaattcccctgtcttgataaaatggctctatctaggcagctggcaaggtgaatccattgggtggttacaatacctcccttagtagactaaagaacaacttggataaaaccagcaagaaatggattatatcgagggaaattgtcatgcccatccaagaccatgataaggaatgaggaagtaacataatggaaggattctgtctcttctcattgggactgactctaagcacctctgattagatgtcattctatgtctgggatgatctcaggactatggtattgtcctcttgtgctatcaattttaactcacaaatggatgtcgatgtcatttattctcttattctacagaccttcattggctacatgggtagtatgggcaagagataggtggtcctgacggaggagtgggaagagccagtgctctggagtgggattactttctggctgcctgctcaggaaagttgtttcaccattctcaacctcagtttccacatctgtaatatatggaaattaatttctacctcataggattgttgtaagtattaaatgagatattattgtaatgcttaattaaatgagataatatatttaaaaatataattcccctagatataatacatatgtatacataatatatacatataatacatatgtatacataacatatacgtataatacgtatgtatacataatctatgcatataatacatatgtatacataatctgtgcgtatataatacatatgtatacataatctgtgcgtatataatacatatgtatacataagctgtgcatatataatacatatgtatacataagctgtgcgtatataatacatatgtatacataagctgtgcgtatagaatacatatgtatacataagctgtgcgtatagaatacatatgtatacataatctgtgcgtatagaatacatatgtatacataatctgtgcgtatagaata

SEQ ID NO: 736601 - DNA, 496 bp, Homo sapiens
aatcttcatgacatatttttatctgaagaagaaaatgaaagcaaagcagtgcccaaaggccccctcctactgaactatcatgatgcacacgcccacaagaagtacgcactacaggaccaaaagaattttgatccagttcaaattgagcaggagatgcagtccaagttgccactgtgggaatttcttcaattccctctacccccaccatggaacaacactaaacgtctagctacaattcatgagcttatgcacttttgtacgagtggtgagtccattgctttgtcttagcttaaactcaatttaattaatggtcatatatgcctcttaaaattacacccttatttacaaaaagtattttcattattgaaagacctttcagaggctaaggtgggtattttgattgactacaactttcttgtttgaataatgtcattagcaatgttatcatagctataatgcataacactcttcaatttgatacactggggtttttttc

SEQ ID NO: 736602 - DNA, 786 bp, Homo sapiens
aatcttcatgacatatttttatctgaagaagaaaatgaaagcaaagcagtgcccaaaggccccctcctactgaactatcatgatgcacacgcccacaagaagtacgcactacaggaccaaaagaattttgatccagttcaaattgagcaggagatgcagtccaagttgccactgtgggaatttcttcaattccctctacccccaccatggaacaacactaaacgtctagctacaattcatgagcttatgcacttttgtacgagtgatgtcttgagctggaatgaagtagaacgagccttcaaggtgtttacttttgagagcctgaagctctctgaggttgatgaaaaagggaaactgaaaccttctgggatgatgtgtgggtcagattctgaaatgttcaacataccgtgggacaaccctgccagatttgctaaacagataaggcagcaatatgtcatgaaaatgaatactcaagaggccaagcagaaagcagatattaaaatcaaagacagaacactatttgtggatcagaatttgtcaatgtctgtgcaagataatgaaagcaaccgagaaccttcagatcctagtcagtgtgatgctaacaatatgaagcattctgacttgaataatctcaaactctcagtccctgataatagacagctgttagagcaggagagcatcatgaaggctcagccccaacatgagtctctgggtaagttaaagtgtgtgtgtgtgtgtgtgtgtgtgtgtgtgtaagacactattatagtacacataaatcaaaaa

SEQ ID NO: 736603 - DNA, 937 bp, Homo sapiens
aatcttcatgacatatttttatctgaagaagaaaatgaaagcaaagcagtgcccaaaggccccctcctactgaactatcatgatgcacacgcccacaagaagtacgcactacaggaccaaaagaattttgatccagttcaaattgagcaggagatgcagtccaagttgccactgtgggaatttcttcaattccctctacccccaccatggaacaacactaaacgtctagctacaattcatgagcttatgcacttttgtacgagtgatgtcttgagctggaatgaagtagaacgagccttcaaggtgtttacttttgagagcctgaagctctctgaggttgatgaaaaagggaaactgaaaccttctgggatgatgtgtgggtcagattctgaaatgttcaacataccgtgggacaaccctgccagatttgctaaacagataaggcagcaatatgtcatgaaaatgaatactcaagaggccaagcagaaagcagatattaaaatcaaagacagaacactatttgtggatcagaatttgtcaatgtctgtgcaagataatgaaagcaaccgagaaccttcagatcctagtcagtgtgatgctaacaatatgaagcattctgacttgaataatctcaaactctcagtccctgataatagacagctgttagagcaggagagcatcatgaaggctcagccccaacatgagtctctgggaattatttggaacttgttgcaaaatctattcaagattggattacaaaagaagaagctatatatcaggaatctaaaatgaatgagaaaatcatcaggaccagagctgagctggaattgaaatcttctgctaatgccaaacttacttctgctagcaaaattttttccattaaagaatctaaaagtaacaaaggaatcagcaaaacagagatatcagatcaagaaaa

SEQ ID NO: 736604 - DNA, 443 bp, Homo sapiens; identical to SEQ ID NO: 83270

SEQ ID NO: 736605 - DNA, 916 bp, Homo sapiens
cacgcgtcgcccacgcgtcgttgtaatggtaatcatgagtatacttaattttatttatgtatagaatatttgtatttattttttggacatatatttatcactttgtcattttttttaaccaatttgagaaatgttagctgctgaattaatttgttgcccgagccttcatattttcttctttgctgccttctccctgtggcaatgtactgttctcacattaagccttttaaaaatgttccatactgtattagcatccttagaagggacagaactaagaaatacattgctcaaataatattttactttattgataatgacaaaaagaatattttttaaaccccatcaaaatagatttcaattgactgtttcccctacatcttttgagccacagtcgcccatcgaataagcaaatttgtttttgagaataaactggtaaccagtttgtgatgactctcagaagccttttggctgggttacagaagagtttctaagttcctagagagccatttaataattagttggtgagccagaggcttgacagagctgttacttatgtgtgagggctttattctcaggcagtagtttattcatcatttggtaagcccctccccacactcctctaatttaaacaagtagtgaaggcttatcttaaactgtgtagtaccttagacttggcatttatttttgatagagcagagataaaatattttgatggaaggaaatcaattttctgtaactgatgatgtgaaaattttattttctgggaaattatatagccattcaaaaattcaaagtatgttattatgattggttacaagagaataatgttacatgtttaattgtaatatttgtctcctatcattttcttccctttcagtcataataaatgatttacaaaacccaaaaaaaaaaatat

SEQ ID NO: 736606 - DNA, 3857 bp, Homo sapiens
atagaattacagaaccacaagggaccttagagaaataatgcacttattttgcaaatgagaaagctgaggcctagagagggaaatgagttacccaaaatcaaatagctagacctgggtctagactctttccataaattatatgtcaaatttctttggtataactttagttattaaaatctttttgaactcggaaggtgaaaaacttgcttcttcagtgaccaaatcatggaaaaatccctggaatcttcttgtttccagtttcaggcagtcctacattacagttcctttttgagtaaaaaatgcgtggccacagtccaaagttaatgtgtgtccaaaaggataagtggaccaaatagcaatttataattacatactaaactcagagccgcacagaggctgaaaacaaaaagcttgagtatatttggtttgatcatattaattgaaaaatttcagtctgcagcacacttgtcttcaaaaaatgttgatttgaaaagtactgtaaatctcagttttccacttcctttctagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctgaaagctggggagcctgaacattcactccttgtcctccatgctgtggctgtatcagctccctacaagttcgtttacacctggcagcacggcagccacacaccggtattccaaaccttaacaatgaagggggttagtctcttttatttgattcttaaatattcaaataaatattaacagtaaaacataaacacaaaatttgccaacacactaattttcttatagagtaaatgagtaagaattcatcattttttccatctcccttctcccttgtcatcagacacattgtgcaatgtggcttttcttttcttttctttttttcccctttttaatattctggcaatctttagaaagggagattccaaactcccatttggtaaaccagttgattatttggaaatgttcactgccaaaatagtaagtgctataactaaatgcgcttttaattaatgatatagtgtttggaaaggagtagaacatgcagcataagaaactgctgcagagtggtgcgaggagtacattttcagagcaggtgcagtacatcttccggctctatgaatcattatgtgagaaagcaggataacattaggtaacctgagcctcctgtgtggtattagaaagtataccgtcaccttttcacatcactggagtgtaaaatttaaaacaagatggtgattcctgacattccttggctgtcagtgctgcccagattcagaagaatattgcccacatttcactgtatttggtgctgggtcattttgaccttgctttgttaataatatctttaaaaacaaagacaatccttaaagctttgctcctcacacattaccttctaattatagtttgaaaatagattccctacacatacatacatatgtatgcacagatagggtcttgctatgttgcccaggctggtcttgaactcctggcctcaagcaatcctctctcctcagcctcccaaagtgctgggattacacgtgtgagccaccacacctggctccagaaattttattttatttttttgaggcagggtctcactctggttgcccaggctggagtgcagtggtgccatcatagctcactgtagcctcgaccttccgggatcaagcaatcccacttcagcctcttgaatagctgggactagaagcatgcaccaccatgcccatctaatatttgtatttttagtagagacaggatctccctatgttgtccagcctagtctcaaactcctgggttcaagcaatcctcccacctcggcctcccaaagtgctgggattgcaggcatgagccaccgtgcccagcctcaaaaatattttttaaaagaaaagagaaaataattcttctgtcaaaggaggttaaattttagttgatagagtacttaaatgcattactttattaggttatgtaagtggtcagtgcattccagtatgtgtcacaacagtgtagttcatattcatgataaaaatgaaactgtgataagacatgaaaattatattattaaaatgttcaattgtaatggtaatcatgagtatacttaattttatttatgtatagaatatttgtatttattttttggacatatatttatcactttgtcattttttttaaccaatttgagaaatgttagctgctgaattaatttgttgcccgagccttcatattttcttctttgctgccttctccctgtggcaatgtactgttctcacattaagccttttaaaaatgttccatactgtattagcatccttagaagggacagaactaagaaatacattgctcaaataatattttactttattgataatgacaaaaagaatattttttaaaccccatcaaaatagatttcaattgactgtttcccctacatcttttgagccacagtcgcccatcgaataagcaaatttgtttttgagaataaactggtaaccagtttgtgatgactctcagaagccttttggctgggttacagaagagtttctaagttcctagagagccatttaataattagttggtgagccagaggcttgacagagctgttacttatgtgtgagggctttattctcaggcagtagtttattcatcatttggtaagcccctccccacactcctctaatttaaacaagtagtgaaggcttatcttaaactgtgtagtaccttagacttggcatttatttttgatagagcagagataaaatattttgatggaaggaaatcaattttctgtaactgatgatgtgaaaattttattttctgggaaattatatagccattcaaaaattcaaagtatgttattatgattggttacaagagaataatgttacatgtttaattgtaatatttgtctcctatcattttcttccctttcagtcataataaatgatttacaaaacccaaaaaaaaaaatat

SEQ ID NO: 736607 - DNA, 3618 bp, Homo sapiens
atagaattacagaaccacaagggaccttagagaaataatgcacttattttgcaaatgagaaagctgaggcctagagagggaaatgagttacccaaaatcaaatagctagacctgggtctagactctttccataaattatatgtcaaatttctttggtataactttagttattaaaatctttttgaactcggaaggtgaaaaacttgcttcttcagtgaccaaatcatggaaaaatccctggaatcttcttgtttccagtttcaggcagtcctacattacagttcctttttgagtaaaaaatgcgtggccacagtccaaagttaatgtgtgtccaaaaggataagtggaccaaatagcaatttataattacatactaaactcagagccgcacagaggctgaaaacaaaaagcttgagtatatttggtttgatcatattaattgaaaaatttcagtctgcagcacacttgtcttcaaaaaatgttgatttgaaaagtactgtaaatctcagttttccacttcctttctagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctgaaagctggggagcctgaacattcactccttgtcctccatgctgtggctgtatcagctccctacaagttcgtttacacctggcagcacggcagccacacaccggtattccaaaccttaacaatgaagggggttagtctcttttatttgattcttaaatattcaaataaatattaacagtaaaacataaacacaaaatttgccaacacactaattttcttatagagtaaatgagtaagaattcatcattttttccatctcccttctcccttgtcatcagacacattgtgcaatgtggcttttcttttcttttctttttttcccctttttaatattctggcaatctttagaaagggagattccaaactcccatttggtaaaccagttgattatttggaaatgttcactgccaaaatagtaagtgctataactaaatgcgcttttaattaatgatatagtgtttggaaaggagtagaacatgcagcataagaaactgctgcagagtggtgcgaggagtacattttcagagcaggtgcagtacatcttccggctctatgaatcattatgtgagaaagcaggataacattaggtaacctgagcctcctgtgtggtattagaaagtataccgtcaccttttcacatcactggagtgtaaaatttaaaacaagatggtgattcctgacattccttggctgtcagtgctgcccagattcagaagaatattgcccacatttcactgtatttggtgctgggtcattttgaccttgctttgttaataatatctttaaaaacaaagacaatccttaaagctttgctcctcacacattaccttctaattatagtttgaaaatagattccctacacatacatacatatgtatgcacagatagggtcttgctatgttgcccaggctggtcttgaactcctggcctcaagcaatcctctctcctcagcctcccaaagtgctgggattacacgtgtgagccaccacacctggctccagaaattttattttatttttttgaggcagggtctcactctggttgcccaggctggagtgcagtggtgccatcatagctcactgtagcctcgaccttccgggatcaagcaatcccacttcagcctcttgaatagctgggactagaagcatgcaccaccatgcccatctaatatttgtatttttagtagagacaggatctccctatgttgtccagcctagtctcaaactcctgggttcaagcaatcctcccacctcggcctcccaaagtgctgggattgcaggcatgagccaccgtgcccagcctcaaaaatattttttaaaagaaaagagaaaataattcttctgtcaaaggaggttaaattttagttgatagagtacttaaatgcattactttattaggttatgtaagtggtcagtgcattccagtatgtgtcacaacagtgtagttcatattcatgataaaaatgaaactgtgataagacatgaaaattatattattaaaatgttcaattgtaatggtaatcatgagtatacttaattttatttatgtatagaatatttgtatttattttttggacatatatttatcactttgtcattttttttaaccaatttgagaaatgttagctgctgaattaatttgttgcccgagccttcatattttcttctttgctgccttctccctgtggcaatgtactgttctcacattaagccttttaaaaatgttccatactgtattagcatccttagaagggacagaactaagaaatacattgctcaaataatattttactttattgataatgacaaaaagaatattttttaaaccccatcaaaatagatttcaattgactgtttccccacactcctctaatttaaacaagtagtgaaggcttatcttaaactgtgtagtaccttagacttggcatttatttttgatagagcagagataaaatattttgatggaaggaaatcaattttctgtaactgatgatgtgaaaattttattttctgggaaattatatagccattcaaaaattcaaagtatgttattatgattggttacaagagaataatgttacatgtttaattgtaatatttgtctcctatcattttcttccctttcagtcataataaatgatttacaaaacccaaaaaaaaaaatat

SEQ ID NO: 736608 - DNA, 3803 bp, Homo sapiens
atagaattacagaaccacaagggaccttagagaaataatgcacttattttgcaaatgagaaagctgaggcctagagagggaaatgagttacccaaaatcaaatagctagacctgggtctagactctttccataaattatatgtcaaatttctttggtataactttagttattaaaatctttttgaactcggaaggtgaaaaacttgcttcttcagtgaccaaatcatggaaaaatccctggaatcttcttgtttccagtttcaggcagtcctacattacagttcctttttgagtaaaaaatgcgtggccacagtccaaagttaatgtgtgtccaaaaggataagtggaccaaatagcaatttataattacatactaaactcagagccgcacagaggctgaaaacaaaaagcttgagtatatttggtttgatcatattaattgaaaaatttcagtctgcagcacacttgtcttcaaaaaatgttgatttgaaaagtactgtaaatctcagttttccacttcctttctagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctgaaagctggggagcctgaacattcactccttgtcctccatgctgtggctgtatcagctccctacaagttcgtttacacctggcagcacggcagccacacaccggtattccaaaccttaacaatgaagggggttagtctcttttatttgattcttaaatattcaaataaatattaacagtaaaacataaacacaaaatttgccaacacactaattttcttatagagtaaatgagtaagaattcatcattttttccatctcccttctcccttgtcatcagacacattgtgcaatgtggcttttcttttcttttctttttttcccctttttaatattctggcaatctttagaaagggagattccaaactcccatttggtaaaccagttgattatttggaaatgttcactgccaaaatagtaagtgctataactaaatgcgcttttaattaatgatatagtgtttggaaaggagtagaacatgcagcataagaaactgctgcagagtggtgcgaggagtacattttcagagcaggtgcagtacatcttccggctctatgaatcattatgtgagaaagcaggataacattaggtaacctgagcctcctgtgtggtattagaaagtataccgtcaccttttcacatcactggagtgtaaaatttaaaacaagatggtgattcctgacattccttggctgtcagtgctgcccagattcagaagaatattgcccacatttcactgtatttggtgctgggtcattttgaccttgctttgttaataatatctttaaaaacaaagacaatccttaaagctttgctcctcacacattaccttctaattatagtttgaaaatagattccctacacatacatacatatgtatgcacagatagggtcttgctatgttgcccaggctggtcttgaactcctggcctcaagcaatcctctctcctcagcctcccaaagtgctgggattacacgtgtgagccaccacacctggctccagaaattttattttatttttttgaggcagggtctcactctggttgcccaggctggagtgcagtggtgccatcatagctcactgtagcctcgaccttccgggatcaagcaatcccacttcagcctcttgaatagctgggactagaagcatgcaccaccatgcccatctaatatttgtatttttagtagagacaggatctccctatgttgtccagcctagtctcaaactcctgggttcaagcaatcctcccacctcggcctcccaaagtgctgggattgcaggcatgagccaccgtgcccagcctcaaaaatattttttaaaagaaaagagaaaataattcttctgtcaaaggaggttaaattttagttgatagagtacttaaatgcattactttattaggttatgtaagtggtcagtgcattccagtatgtgtcacaacagtgtagttcatattcatgataaaaatgaaactgtgataagacatgaaaattatattattaaaatgttcaattgtaatggtaatcatgagtatacttaattttatttatgtatagaatatttgtatttattttttggacatatatttatcactttgtcattttttttaaccaatttgagaaatgttagctgctgaattaatttgttgcccgagccttcatattttcttctttgctgccttctccctgtggcaatgtactgttctcacattaagccttttaaaaatgttccatactgtattagcatccttagaagggacagaactaagaaatacattgctcaaataatattttactttattgataatgacaaaaagaatattttttaaaccccatatcgaataagcaaatttgtttttgagaataaactggtaaccagtttgtgatgactctcagaagccttttggctgggttacagaagagtttctaagttcctagagagccatttaataattagttggtgagccagaggcttgacagagctgttacttatgtgtgagggctttattctcaggcagtagtttattcatcatttggtaagcccctccccacactcctctaatttaaacaagtagtgaaggcttatcttaaactgtgtagtaccttagacttggcatttatttttgatagagcagagataaaatattttgatggaaggaaatcaattttctgtaactgatgatgtgaaaattttattttctgggaaattatatagccattcaaaaattcaaagtatgttattatgattggttacaagagaataatgttacatgtttaattgtaatatttgtctcctatcattttcttccctttcagtcataataaatgatttacaaaacccaaaaaaaaaaatat

SEQ ID NO: 736609 - DNA, 2301 bp, Homo sapiens
atagaattacagaaccacaagggaccttagagaaataatgcacttattttgcaaatgagaaagctgaggcctagagagggaaatgagttacccaaaatcaaatagctagacctgggtctagactctttccataaattatatgtcaaatttctttggtataactttagttattaaaatctttttgaactcggaaggtgaaaaacttgcttcttcagtgaccaaatcatggaaaaatccctggaatcttcttgtttccagtttcaggcagtcctacattacagttcctttttgagtaaaaaatgcgtggccacagtccaaagttaatgtgtgtccaaaaggataagtggaccaaatagcaatttataattacatactaaactcagagccgcacagaggctgaaaacaaaaagcttgagtatatttggtttgatcatattaattgaaaaatttcagtctgcagcacacttgtcttcaaaaaatgttgatttgaaaagtactgtaaatctcagttttccacttcctttctagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctgaaagctggggagcctgaacattcactccttgtcctccatgctgtggctgtatcagctccctacaagttcgtttacacctggcagcacggcagccacacaccggtattccaaaccttaacaatgaagggggttagtctcttttatttgattcttaaatattcaaataaatattaacagtaaaacataaacacaaaatttgccaacacactaattttcttatagagtaaatgagtaagaattcatcattttttccatctcccttctcccttgtcatcagacacattgtgcaatgtggcttttcttttcttttctttttttcccctttttaatattctggcaatctttagaaagggagattccaaactcccatttggtaaaccagttgattatttggaaatgttcactgccaaaatagtaagtgctataactaaatgcgcttttaattaatgatatagtgtttggaaaggagtagaacatgcagcataagaaactgctgcagagtggtgcgaggagtacattttcagagcaggtgcagtacatcttccggctctatgaatcattatgtgagaaagcaggataacattaggtaacctgagcctcctgtgtggtattagaaagtataccgtcaccttttcacatcactggagtgtaaaatttaaaacaagatggtgattcctgacattccttggctgtcagtgctgcccagattcagaagaatattgcccacatttcactgtatttggtgctgggtcattttgaccttgctttgttaataatatctttaaaaacaaagacaatccttaaagctttgctcctcacacagtagcgaacgggtaccgagcttacc

SEQ ID NO: 736610 - DNA, 1831 bp, Homo sapiens; identical to SEQ ID NO: 416475

SEQ ID NO: 736611 - DNA, 661 bp, Homo sapiens
  misc_feature (31)..(31): n is a, c, g, or t
tcttgtaccaggatccactcgacagacttancgcatgattaatttgattgattactcttgaagttactgaccttaggaaaattcctcaattgtaaaaaggctttctctatatgtaaattatgctgttatctttttctatacacaaagtatatagacctataaatattatacatatatattatatatataaagactaattcttgtacagaccaacgcggaccgatggtccatattcttttctccatgtttgtttgtgtcgactgttgcagagtgagttgatgtaagaaggtggtttcatgttttcttttggggggccacttctttcttttcctttccgtttctatctctgtctgtctccgtctctgtctctctctttctcacttgttgccaatgtcttgttgctgagaaggaacactctattcagatgccatccaggaaagaaaggccagatggatggagggtccactgtgtatatttgtacagaatcatttataaagttttctacacttctaaaaaaagtatttctaacttgggctgttggacagtttgtgtgcctctgagccggcaagcctgttgtttcttgtgtttagtgcaatgtttagtgagaaaccaatgtctgaattatttatgccaataaaaaatttgagaattactgcattgc

SEQ ID NO: 736612 - DNA, 558 bp, Homo sapiens
  misc_feature (31)..(31): n is a, c, g, or t
  misc_feature (522)..(522): n is a, c, g, or t
  misc_feature (528)..(528): n is a, c, g, or t
  misc_feature (538)..(539): n is a, c, g, or t
tcttgtaccaggatccactcgacagacttancgcatgattaatttgattgattactcttgaagttactgaccttaggaaaattcctcaattgtaaaaaggctttctctatatgtaaattatgctgttatctttttctatacacaaagtatatagacctataaatattatacatatatattatatatataaagactaattcttgtacagaccaacgcggaccgatggtccatattcttttctccatgtttgtttgtgtcgactgttgcagagtgagttgatgtaagaaggtggtttcatgttttcttttggggggccacttctttcttttcctttccgtttctatctctgtctgtctccgtctctgtctctctctttctcacttgttgccaatgtcttgttgctgagaaggaacactctattcagatgccatccaggaaagaaaggccagatggatggagggtccactgtgtatatttgtacagaatcatttataaagttttctacacttctaaaaaaagtanggatancttaagcatnntgcagaccgccgaaaaacg

SEQ ID NO: 736613 - DNA, 3815 bp, Homo sapiens
  misc_feature (18)..(18): n is a, c, g, or t
  misc_feature (34)..(35): n is a, c, g, or t
  misc_feature (44)..(45): n is a, c, g, or t
gcttaatctccttgtgancaacaaacctttgagnnccccattgnnacgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaatttcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggtttttttattttgttttgttttgttttgtttttttttttttttggctacacttttttgggggggaccttttaatttgggaagaaaatgctgagtatacttttctttcacaaccattgcaaacccaggtagccctggagttttctttttttctcatcatcattgttttgttttttttatggttcaagacttttgcaatacatgaattaaaaataagcagttctttaaagcatagcgctctaaaaactattcttagtttataccctcaaaagttgggtctttcatgaaacacagtggtttgaatatgaacaccagtagcattctcgttcgttgttagggtaagagagttttgtagaatgatctccaaaagaagcagtcctcaaaaggcatttaccagtgatatcttttaatattcatgtttttatttaatgatgtaagatagaattaataaactactaaggaaataagccaatgtggttattgtactcaatttcgtttttcttttagaaatgtgtattgacttattaaagccactgacagaaatgttaatcatgacttaagttctaatttaaaaaactattttcctctttcctaaatactatattctaaattggaatatggcaaaatcccaatatataattctatacctagtaaagattgtaaataactaaaacaaaatgataagagctgtgaactgaaattgtattgcttacagaaatcatgaaccgaattttcttctctttttaaagtgagcataaagacttaagtgtattgttaccagagatatatttagatagaatacatcattttggcaggtaatcttctagaacctttcatgtactgtttccatcaagggagggaaagaaatagaaaatataattttatctatattttccttaaaatatatcaatctgtgcacactctttcagttttttaattactcatgtaatatatgactacattttgcttgtgtgctttttgaaaaccatcttcagtcccaatatcctctgtagaagtaatagttttaactctcctagatcttcttttagagtgtttttatgagtgtttaatgtaggaatgtgtatatattatctacagccacaggaaatgtatagttacgatttttacatacgtgtatgtatattattgtacaacttgctatttctacttgggagttttttattttggtacattcacatttacctaatctcttgtgcactgtccaacagtactttgcctataatagacacttaaggaagttttccttctttttattcctttataattacaaacaatgctgaaaggaacatcatcctacatgagccctttttgtacatataaggctctctctgtggtatatgcttaggatttgaatttcaggccagagtataaccatttttaatttgaagagatacttccatttgggttccagaatggctgtatcaagttacagttcccctgagcaagatatgagcatctgcttccccatgtaattaatgacacttgctattggatttttgtaatttaattactctgaaaaaattattttggttttaaatcagaaatttctcactagtgaagatggacatatttttgtatgtttattttagaacatataaacatttgttaattttctttttcctctcatttttctattgaatgatttgtccttttatctcatggatttgttaggagttctcttgtattttctgtattttatgtctgttgccaatgttttctcctacttagccatttggctttaattttacatggtgtctgtttaaataaatgttttatatttgtatacaatcaaattgattaattttcatgacttatttcaggatataaagcaaattattttctaagacatttacagtgtatgttttcctatgtttacatgtgctcatttcacgtcatgtattttcctctacgacatgtttctgtgtgagtagttaacatgtagatctttagaattgatttttctgaagagtgaaacagcgctgcttccaatatctgttcaaaattcatttattgaaaagtccactcatatgtctgatttgaaatgctgtttcattatgtgttaaattctttcactgagctcttccatattcctagtaaatgatgcattactttggtatgttctcagatttgggtaaagccttcctcatgttctataaaaattggttaactgctggtgagcacatctcttgaagttttgatatgggttgcacaacatttataggactgatttggagagaccgacaataccgagtgcagtcctcccttggtatctagttccaggacccctgtggataccaaaatccaagcaatgccctgcagatcatgggacctatgcatatgaaaagtcggtccttgtatttgagggttttgcatccctcaaataccatatgttttatttgtgtttggttgaaaaaagtttgcatataagtgaaacttagcatttcaaacctgtgttgttcaaagatcatttgtatttctcttcaagaacaatgaatgtcttcattaaatcatcttttgtgggagagcttttggtttcatagattttcatatatatatatgatataataaacactttttgacattcaaaaaaaaa

SEQ ID NO: 736614 - DNA, 726 bp, Homo sapiens
catgatttaatattttaatgataattataatgatttcagatacctctgtttgctccatggatgtgttatttatcattcatgacttgcttctgaaattgagagcagcattactgttgtcatataacagtcatataacatgcaaataatatttttattaaaatataagttattccctttcatgatgtttctataaagatactgcagtcctaaattttttttactgtagcctgtaatataacatgatttttacacacgtatttttttttccacttaggacatttaatttcttaatgaggtggcatagcatagtagttagtttgagacctagaatttgtctggacaatattactaaccttgtgacattagcttaatcatcagaatagtgtgtggaagagtaagaacttaataaatatcacctattattatttcactttttaatgtgtagctgatattgttttcctccaaaaaaaaaaaaatacagctttcaactatttttcttcttgtagtaaacttctatatacatttccaggatggaaagttggagtgacagctcttcagcaggttagtctgagatttcccagaaagcacgaagaacatcagggtggagagtttcactctcagcgacaaatagaaataatccacttgattccacatgaacttagaggtccttggaaagcagaaatgctgtttctagcacagagtaagtgctcagttatagtttgttga

SEQ ID NO: 736615 - DNA, 413 bp, Homo sapiens
ggaagcggtgttgtgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgtgagtgacttcttttgttagcttcccagttcccatttaccacgggcttcccttctttaacccctccctgtcctattaatatttcgccatccggtcacgtccacgtgctgatttggcacttgcagtcctcctg

SEQ ID NO: 736616 - DNA, 6440 bp, Homo sapiens
ggaagcggtgttgtgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgttcagaaacttagtctggttgcagtaagtaattctgttccacaggatatctgctgtatggcagctgatggcagattagtctttgctgcttatggaaatgttttctctgcatttgcccgtaataaagagatagtacatacctttaagggtcataaggcagaaatccatttcttgcaaccctttggagaccacattatctctgttgatactgatggcattcttattatttggcacatatattcagaagaagaatacctgcagttgacttttgataaatcagtatttaaaatttctgcaattttgcatccaagtacctacttgaataaaatacttctgggcagtgaacaaggaagcctgcagttgtggaatgtaaaatccaataaacttctatatacatttccaggatggaaagttggagtgacagctcttcagcaggttagtgcaccagccgtggatgttgttgctattggtcttatgtcaggtcaagttatcattcacaacattaaatttaatgaaacattaatgaagtttcgtcaagactggggacccattacttcaatttcatttcgcacagatggtcatccagtaatggcagctggaagcccatgtggccatattggactctgggatctagaagacaaaaaattaatcaaccaaatgagaaatgcacactctacagcaattgccggactgacatttctccatagagagccacttcttgtcacaaatggcgctgacaatgctcttaggatatggatatttgatggtcctacaggtgaaggccgacttttgagattcagaatgggtcatagtgctcctcttaccaatatcagatattatggacagaatggacagcagattctaagtgcaagtcaagatggaactcttcagtcattttccacggtacatgaaaaattcaataagagcttgggacatggattaataaataaaaagagagttaaacgtaaaggacttcagaataccatgtcagtgagacttccacccatcacaaagtttgcagcagaggaagctcgtgaaagtgactgggatggtatcattgcttgccatcaaggtaagctatcttgctcaacctggaattatcagaaatctacaataggcgcttactttctcaagccaaaagagttgaagaaagatgacataactgcaacagcagtggatataacttcttgtggaaactttgctgtaattggcctctcatcaggaactgtagatgtatataacatgcagtctggcatacatcgaggaagttttggcaaggatcaagctcacaagggatctgttagaggtgtcgcagtggatggattaaaccagttgacagttacaactggtagtgaaggattactcaaattctggaactttaaaaacaaaattttaatccattctgtgagcctcagttcatctccaaatatcatgttgctacatagggacagtggcattctgggactcgccttggatgacttctccattagtgttctggacatagaaactaggaagattgtcagagagttttctggacaccaaggccaaataaatgacatggcttttagtcctgatggtcgttggttaataagtgctgcgatggattgctctattaggacttgggaccttccttctgggtgccttatagactgctttttgttggactcggctcctctcaatgtttctatgtctcctactggagactttctggcaacttcccatgtggaccaccttggaatttatctatggtccaatatttccctgtattcagttgtttcattacggccacttcctgcagattatgtcccttcaatagtcatgcttcctggtacttgtcaaacccaagatgtagaagtatcagaagaaacagtagaaccaagtgatgaattgatagaatatgattcgccagaacagttgaatgagcaattggtgactctttcacttcttcctgaatcacgatggaaaaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaataaaatcgcacctcccggccaggcatgatggataatgcctgtaattccagcactttcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggtttttttattttgttttgttttgttttgtttttttttttttttggctacacttttttgggggggaccttttaatttgggaagaaaatgctgagtatacttttctttcacaaccattgcaaacccaggtagccctggagttttctttttttctcatcatcattgttttgttttttttatggttcaagacttttgcaatacatgaattaaaaataagcagttctttaaagcatagcgctctaaaaactattcttagtttataccctcaaaagttgggtctttcatgaaacacagtggtttgaatatgaacaccagtagcattctcgttcgttgttagggtaagagagttttgtagaatgatctccaaaagaagcagtcctcaaaaggcatttaccagtgatatcttttaatattcatgtttttatttaatgatgtaagatagaattaataaactactaaggaaataagccaatgtggttattgtactcaatttcgtttttcttttagaaatgtgtattgacttattaaagccactgacagaaatgttaatcatgacttaagttctaatttaaaaaactattttcctctttcctaaatactatattctaaattggaatatggcaaaatcccaatatataattctatacctagtaaagattgtaaataactaaaacaaaatgataagagctgtgaactgaaattgtattgcttacagaaatcatgaaccgaattttcttctctttttaaagtgagcataaagacttaagtgtattgttaccagagatatatttagatagaatacatcattttggcaggtaatcttctagaacctttcatgtactgtttccatcaagggagggaaagaaatagaaaatataattttatctatattttccttaaaatatatcaatctgtgcacactctttcagttttttaattactcatgtaatatatgactacattttgcttgtgtgctttttgaaaaccatcttcagtcccaatatcctctgtagaagtaatagttttaactctcctagatcttcttttagagtgtttttatgagtgtttaatgtaggaatgtgtatatattatctacagccacaggaaatgtatagttacgatttttacatacgtgtatgtatattattgtacaacttgctatttctacttgggagttttttattttggtacattcacatttacctaatctcttgtgcactgtccaacagtactttgcctataatagacacttaaggaagttttccttctttttattcctttataattacaaacaatgctgaaaggaacatcatcctacatgagccctttttgtacatataaggctctctctgtggtatatgcttaggatttgaatttcaggccagagtataaccatttttaatttgaagagatacttccatttgggttccagaatggctgtatcaagttacagttcccctgagcaagatatgagcatctgcttccccatgtaattaatgacacttgctattggatttttgtaatttaattactctgaaaaaattattttggttttaaatcagaaatttctcactagtgaagatggacatatttttgtatgtttattttagaacatataaacatttgttaattttctttttcctctcatttttctattgaatgatttgtccttttatctcatggatttgttaggagttctcttgtattttctgtattttatgtctgttgccaatgttttctcctacttagccatttggctttaattttacatggtgtctgtttaaataaatgttttatatttgtatacaatcaaattgattaattttcatgacttatttcaggatataaagcaaattattttctaagacatttacagtgtatgttttcctatgtttacatgtgctcatttcacgtcatgtattttcctctacgacatgtttctgtgtgagtagttaacatgtagatctttagaattgatttttctgaagagtgaaacagcgctgcttccaatatctgttcaaaattcatttattgaaaagtccactcatatgtctgatttgaaatgctgtttcattatgtgttaaattctttcactgagctcttccatattcctagtaaatgatgcattactttggtatgttctcagatttgggtaaagccttcctcatgttctataaaaattggttaactgctggtgagcacatctcttgaagttttgatatgggttgcacaacatttataggactgatttggagagaccgacaataccgagtgcagtcctcccttggtatctagttccaggacccctgtggataccaaaatccaagcaatgccctgcagatcatgggacctatgcatatgaaaagtcggtccttgtatttgagggttttgcatccctcaaataccatatgttttatttgtgtttggttgaaaaaagtttgcatataagtgaaacttagcatttcaaacctgtgttgttcaaagatcatttgtatttctcttcaagaacaatgaatgtcttcattaaatcatcttttgtgggagagcttttggtttcatagattttcatatatatatatgatataataaacactttttgacattcaaaaaaaaa

SEQ ID NO: 736617 - DNA, 6286 bp, Homo sapiens
catgatttaatattttaatgataattataatgatttcagatacctctgtttgctccatggatgtgttatttatcattcatgacttgcttctgaaattgagagcagcattactgttgtcatataacagtcatataacatgcaaataatatttttattaaaatataagttattccctttcatgatgtttctataaagatactgcagtcctaaattttttttactgtagcctgtaatataacatgatttttacacacgtatttttttttccacttaggacatttaatttcttaatgaggtggcatagcatagtagttagtttgagacctagaatttgtctggacaatattactaaccttgtgacattagcttaatcatcagaatagtgtgtggaagagtaagaacttaataaatatcacctattattatttcactttttaatgtgtagctgatattgttttcctccaaaaaaaaaaaaatacagctttcaactatttttcttcttgtagtaaacttctatatacatttccaggatggaaagttggagtgacagctcttcagcaggttagtgcaccagccgtggatgttgttgctattggtcttatgtcaggtcaagttatcattcacaacattaaatttaatgaaacattaatgaagtttcgtcaagactggggacccattacttcaatttcatttcgcacagatggtcatccagtaatggcagctggaagcccatgtggccatattggactctgggatctagaagacaaaaaattaatcaaccaaatgagaaatgcacactctacagcaattgccggactgacatttctccatagagagccacttcttgtcacaaatggcgctgacaatgctcttaggatatggatatttgatggtcctacaggtgaaggccgacttttgagattcagaatgggtcatagtgctcctcttaccaatatcagatattatggacagaatggacagcagattctaagtgcaagtcaagatggaactcttcagtcattttccacggtacatgaaaaattcaataagagcttgggacatggattaataaataaaaagagagttaaacgtaaaggacttcagaataccatgtcagtgagacttccacccatcacaaagtttgcagcagaggaagctcgtgaaagtgactgggatggtatcattgcttgccatcaaggtaagctatcttgctcaacctggaattatcagaaatctacaataggcgcttactttctcaagccaaaagagttgaagaaagatgacataactgcaacagcagtggatataacttcttgtggaaactttgctgtaattggcctctcatcaggaactgtagatgtatataacatgcagtctggcatacatcgaggaagttttggcaaggatcaagctcacaagggatctgttagaggtgtcgcagtggatggattaaaccagttgacagttacaactggtagtgaaggattactcaaattctggaactttaaaaacaaaattttaatccattctgtgagcctcagttcatctccaaatatcatgttgctacatagggacagtggcattctgggactcgccttggatgacttctccattagtgttctggacatagaaactaggaagattgtcagagagttttctggacaccaaggccaaataaatgacatggcttttagtcctgatggtcgttggttaataagtgctgcgatggattgctctattaggacttgggaccttccttctgggtgccttatagactgctttttgttggactcggctcctctcaatgtttctatgtctcctactggagactttctggcaacttcccatgtggaccaccttggaatttatctatggtccaatatttccctgtattcagttgtttcattacggccacttcctgcagattatgtcccttcaatagtcatgcttcctggtacttgtcaaacccaagatgtagaagtatcagaagaaacagtagaaccaagtgatgaattgatagaatatgattcgccagaacagttgaatgagcaattggtgactctttcacttcttcctgaatcacgatggaaaaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaataaaatcgcacctcccggccaggcatgatggataatgcctgtaattccagcactttcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggtttttttattttgttttgttttgttttgtttttttttttttttggctacacttttttgggggggaccttttaatttgggaagaaaatgctgagtatacttttctttcacaaccattgcaaacccaggtagccctggagttttctttttttctcatcatcattgttttgttttttttatggttcaagacttttgcaatacatgaattaaaaataagcagttctttaaagcatagcgctctaaaaactattcttagtttataccctcaaaagttgggtctttcatgaaacacagtggtttgaatatgaacaccagtagcattctcgttcgttgttagggtaagagagttttgtagaatgatctccaaaagaagcagtcctcaaaaggcatttaccagtgatatcttttaatattcatgtttttatttaatgatgtaagatagaattaataaactactaaggaaataagccaatgtggttattgtactcaatttcgtttttcttttagaaatgtgtattgacttattaaagccactgacagaaatgttaatcatgacttaagttctaatttaaaaaactattttcctctttcctaaatactatattctaaattggaatatggcaaaatcccaatatataattctatacctagtaaagattgtaaataactaaaacaaaatgataagagctgtgaactgaaattgtattgcttacagaaatcatgaaccgaattttcttctctttttaaagtgagcataaagacttaagtgtattgttaccagagatatatttagatagaatacatcattttggcaggtaatcttctagaacctttcatgtactgtttccatcaagggagggaaagaaatagaaaatataattttatctatattttccttaaaatatatcaatctgtgcacactctttcagttttttaattactcatgtaatatatgactacattttgcttgtgtgctttttgaaaaccatcttcagtcccaatatcctctgtagaagtaatagttttaactctcctagatcttcttttagagtgtttttatgagtgtttaatgtaggaatgtgtatatattatctacagccacaggaaatgtatagttacgatttttacatacgtgtatgtatattattgtacaacttgctatttctacttgggagttttttattttggtacattcacatttacctaatctcttgtgcactgtccaacagtactttgcctataatagacacttaaggaagttttccttctttttattcctttataattacaaacaatgctgaaaggaacatcatcctacatgagccctttttgtacatataaggctctctctgtggtatatgcttaggatttgaatttcaggccagagtataaccatttttaatttgaagagatacttccatttgggttccagaatggctgtatcaagttacagttcccctgagcaagatatgagcatctgcttccccatgtaattaatgacacttgctattggatttttgtaatttaattactctgaaaaaattattttggttttaaatcagaaatttctcactagtgaagatggacatatttttgtatgtttattttagaacatataaacatttgttaattttctttttcctctcatttttctattgaatgatttgtccttttatctcatggatttgttaggagttctcttgtattttctgtattttatgtctgttgccaatgttttctcctacttagccatttggctttaattttacatggtgtctgtttaaataaatgttttatatttgtatacaatcaaattgattaattttcatgacttatttcaggatataaagcaaattattttctaagacatttacagtgtatgttttcctatgtttacatgtgctcatttcacgtcatgtattttcctctacgacatgtttctgtgtgagtagttaacatgtagatctttagaattgatttttctgaagagtgaaacagcgctgcttccaatatctgttcaaaattcatttattgaaaagtccactcatatgtctgatttgaaatgctgtttcattatgtgttaaattctttcactgagctcttccatattcctagtaaatgatgcattactttggtatgttctcagatttgggtaaagccttcctcatgttctataaaaattggttaactgctggtgagcacatctcttgaagttttgatatgggttgcacaacatttataggactgatttggagagaccgacaataccgagtgcagtcctcccttggtatctagttccaggacccctgtggataccaaaatccaagcaatgccctgcagatcatgggacctatgcatatgaaaagtcggtccttgtatttgagggttttgcatccctcaaataccatatgttttatttgtgtttggttgaaaaaagtttgcatataagtgaaacttagcatttcaaacctgtgttgttcaaagatcatttgtatttctcttcaagaacaatgaatgtcttcattaaatcatcttttgtgggagagcttttggtttcatagattttcatatatatatatgatataataaacactttttgacattcaaaaaaaaa

SEQ ID NO: 736618 - DNA, 4427 bp, Homo sapiens
atcatggctgcagatgatctgtgctttcttacattatgactgcacatggttacttgtgtaatacccgaggatgttagatagtattcaagcatggagaacaagttatgtaacctagacgatgagtgatgtaagtatcagaagttgttgaatttgacgaggatcaagttcgaaatgcaaggctattgggtagcattctctatacgttctatcttgaattcatcccatcgtgattaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaataaaatcgcacctcccggccaggcatgatggataatgcctgtaattccagcactttcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggtttttttattttgttttgttttgttttgtttttttttttttttggctacacttttttgggggggaccttttaatttgggaagaaaatgctgagtatacttttctttcacaaccattgcaaacccaggtagccctggagttttctttttttctcatcatcattgttttgttttttttatggttcaagacttttgcaatacatgaattaaaaataagcagttctttaaagcatagcgctctaaaaactattcttagtttataccctcaaaagttgggtctttcatgaaacacagtggtttgaatatgaacaccagtagcattctcgttcgttgttagggtaagagagttttgtagaatgatctccaaaagaagcagtcctcaaaaggcatttaccagtgatatcttttaatattcatgtttttatttaatgatgtaagatagaattaataaactactaaggaaataagccaatgtggttattgtactcaatttcgtttttcttttagaaatgtgtattgacttattaaagccactgacagaaatgttaatcatgacttaagttctaatttaaaaaactattttcctctttcctaaatactatattctaaattggaatatggcaaaatcccaatatataattctatacctagtaaagattgtaaataactaaaacaaaatgataagagctgtgaactgaaattgtattgcttacagaaatcatgaaccgaattttcttctctttttaaagtgagcataaagacttaagtgtattgttaccagagatatatttagatagaatacatcattttggcaggtaatcttctagaacctttcatgtactgtttccatcaagggagggaaagaaatagaaaatataattttatctatattttccttaaaatatatcaatctgtgcacactctttcagttttttaattactcatgtaatatatgactacattttgcttgtgtgctttttgaaaaccatcttcagtcccaatatcctctgtagaagtaatagttttaactctcctagatcttcttttagagtgtttttatgagtgtttaatgtaggaatgtgtatatattatctacagccacaggaaatgtatagttacgatttttacatacgtgtatgtatattattgtacaacttgctatttctacttgggagttttttattttggtacattcacatttacctaatctcttgtgcactgtccaacagtactttgcctataatagacacttaaggaagttttccttctttttattcctttataattacaaacaatgctgaaaggaacatcatcctacatgagccctttttgtacatataaggctctctctgtggtatatgcttaggatttgaatttcaggccagagtataaccatttttaatttgaagagatacttccatttgggttccagaatggctgtatcaagttacagttcccctgagcaagatatgagcatctgcttccccatgtaattaatgacacttgctattggatttttgtaatttaattactctgaaaaaattattttggttttaaatcagaaatttctcactagtgaagatggacatatttttgtatgtttattttagaacatataaacatttgttaattttctttttcctctcatttttctattgaatgatttgtccttttatctcatggatttgttaggagttctcttgtattttctgtattttatgtctgttgccaatgttttctcctacttagccatttggctttaattttacatggtgtctgtttaaataaatgttttatatttgtatacaatcaaattgattaattttcatgacttatttcaggatataaagcaaattattttctaagacatttacagtgtatgttttcctatgtttacatgtgctcatttcacgtcatgtattttcctctacgacatgtttctgtgtgagtagttaacatgtagatctttagaattgatttttctgaagagtgaaacagcgctgcttccaatatctgttcaaaattcatttattgaaaagtccactcatatgtctgatttgaaatgctgtttcattatgtgttaaattctttcactgagctcttccatattcctagtaaatgatgcattactttggtatgttctcagatttgggtaaagccttcctcatgttctataaaaattggttaactgctggtgagcacatctcttgaagttttgatatgggttgcacaacatttataggactgatttggagagaccgacaataccgagtgcagtcctcccttggtatctagttccaggacccctgtggataccaaaatccaagcaatgccctgcagatcatgggacctatgcatatgaaaagtcggtccttgtatttgagggttttgcatccctcaaataccatatgttttatttgtgtttggttgaaaaaagtttgcatataagtgaaacttagcatttcaaacctgtgttgttcaaagatcatttgtatttctcttcaagaacaatgaatgtcttcattaaatcatcttttgtgggagagcttttggtttcatagattttcatatatatatatgatataataaacactttttgacattcaaaaaaaaa

SEQ ID NO: 736619 - DNA, 6421 bp, Homo sapiens
gcagccgtggcctctcccccacgcgtagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgttcagaaacttagtctggttgcagtaagtaattctgttccacaggatatctgctgtatggcagctgatggcagattagtctttgctgcttatggaaatgttttctctgcatttgcccgtaataaagagatagtacatacctttaagggtcataaggcagaaatccatttcttgcaaccctttggagaccacattatctctgttgatactgatggcattcttattatttggcacatatattcagaagaagaatacctgcagttgacttttgataaatcagtatttaaaatttctgcaattttgcatccaagtacctacttgaataaaatacttctgggcagtgaacaaggaagcctgcagttgtggaatgtaaaatccaataaacttctatatacatttccaggatggaaagttggagtgacagctcttcagcaggttagtgcaccagccgtggatgttgttgctattggtcttatgtcaggtcaagttatcattcacaacattaaatttaatgaaacattaatgaagtttcgtcaagactggggacccattacttcaatttcatttcgcacagatggtcatccagtaatggcagctggaagcccatgtggccatattggactctgggatctagaagacaaaaaattaatcaaccaaatgagaaatgcacactctacagcaattgccggactgacatttctccatagagagccacttcttgtcacaaatggcgctgacaatgctcttaggatatggatatttgatggtcctacaggtgaaggccgacttttgagattcagaatgggtcatagtgctcctcttaccaatatcagatattatggacagaatggacagcagattctaagtgcaagtcaagatggaactcttcagtcattttccacggtacatgaaaaattcaataagagcttgggacatggattaataaataaaaagagagttaaacgtaaaggacttcagaataccatgtcagtgagacttccacccatcacaaagtttgcagcagaggaagctcgtgaaagtgactgggatggtatcattgcttgccatcaaggtaagctatcttgctcaacctggaattatcagaaatctacaataggcgcttactttctcaagccaaaagagttgaagaaagatgacataactgcaacagcagtggatataacttcttgtggaaactttgctgtaattggcctctcatcaggaactgtagatgtatataacatgcagtctggcatacatcgaggaagttttggcaaggatcaagctcacaagggatctgttagaggtgtcgcagtggatggattaaaccagttgacagttacaactggtagtgaaggattactcaaattctggaactttaaaaacaaaattttaatccattctgtgagcctcagttcatctccaaatatcatgttgctacatagggacagtggcattctgggactcgccttggatgacttctccattagtgttctggacatagaaactaggaagattgtcagagagttttctggacaccaaggccaaataaatgacatggcttttagtcctgatggtcgttggttaataagtgctgcgatggattgctctattaggacttgggaccttccttctgggtgccttatagactgctttttgttggactcggctcctctcaatgtttctatgtctcctactggagactttctggcaacttcccatgtggaccaccttggaatttatctatggtccaatatttccctgtattcagttgtttcattacggccacttcctgcagattatgtcccttcaatagtcatgcttcctggtacttgtcaaacccaagatgtagaagtatcagaagaaacagtagaaccaagtgatgaattgatagaatatgattcgccagaacagttgaatgagcaattggtgactctttcacttcttcctgaatcacgatggaaaaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaataaaatcgcacctcccggccaggcatgatggataatgcctgtaattccagcactttcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggtttttttattttgttttgttttgttttgtttttttttttttttggctacacttttttgggggggaccttttaatttgggaagaaaatgctgagtatacttttctttcacaaccattgcaaacccaggtagccctggagttttctttttttctcatcatcattgttttgttttttttatggttcaagacttttgcaatacatgaattaaaaataagcagttctttaaagcatagcgctctaaaaactattcttagtttataccctcaaaagttgggtctttcatgaaacacagtggtttgaatatgaacaccagtagcattctcgttcgttgttagggtaagagagttttgtagaatgatctccaaaagaagcagtcctcaaaaggcatttaccagtgatatcttttaatattcatgtttttatttaatgatgtaagatagaattaataaactactaaggaaataagccaatgtggttattgtactcaatttcgtttttcttttagaaatgtgtattgacttattaaagccactgacagaaatgttaatcatgacttaagttctaatttaaaaaactattttcctctttcctaaatactatattctaaattggaatatggcaaaatcccaatatataattctatacctagtaaagattgtaaataactaaaacaaaatgataagagctgtgaactgaaattgtattgcttacagaaatcatgaaccgaattttcttctctttttaaagtgagcataaagacttaagtgtattgttaccagagatatatttagatagaatacatcattttggcaggtaatcttctagaacctttcatgtactgtttccatcaagggagggaaagaaatagaaaatataattttatctatattttccttaaaatatatcaatctgtgcacactctttcagttttttaattactcatgtaatatatgactacattttgcttgtgtgctttttgaaaaccatcttcagtcccaatatcctctgtagaagtaatagttttaactctcctagatcttcttttagagtgtttttatgagtgtttaatgtaggaatgtgtatatattatctacagccacaggaaatgtatagttacgatttttacatacgtgtatgtatattattgtacaacttgctatttctacttgggagttttttattttggtacattcacatttacctaatctcttgtgcactgtccaacagtactttgcctataatagacacttaaggaagttttccttctttttattcctttataattacaaacaatgctgaaaggaacatcatcctacatgagccctttttgtacatataaggctctctctgtggtatatgcttaggatttgaatttcaggccagagtataaccatttttaatttgaagagatacttccatttgggttccagaatggctgtatcaagttacagttcccctgagcaagatatgagcatctgcttccccatgtaattaatgacacttgctattggatttttgtaatttaattactctgaaaaaattattttggttttaaatcagaaatttctcactagtgaagatggacatatttttgtatgtttattttagaacatataaacatttgttaattttctttttcctctcatttttctattgaatgatttgtccttttatctcatggatttgttaggagttctcttgtattttctgtattttatgtctgttgccaatgttttctcctacttagccatttggctttaattttacatggtgtctgtttaaataaatgttttatatttgtatacaatcaaattgattaattttcatgacttatttcaggatataaagcaaattattttctaagacatttacagtgtatgttttcctatgtttacatgtgctcatttcacgtcatgtattttcctctacgacatgtttctgtgtgagtagttaacatgtagatctttagaattgatttttctgaagagtgaaacagcgctgcttccaatatctgttcaaaattcatttattgaaaagtccactcatatgtctgatttgaaatgctgtttcattatgtgttaaattctttcactgagctcttccatattcctagtaaatgatgcattactttggtatgttctcagatttgggtaaagccttcctcatgttctataaaaattggttaactgctggtgagcacatctcttgaagttttgatatgggttgcacaacatttataggactgatttggagagaccgacaataccgagtgcagtcctcccttggtatctagttccaggacccctgtggataccaaaatccaagcaatgccctgcagatcatgggacctatgcatatgaaaagtcggtccttgtatttgagggttttgcatccctcaaataccatatgttttatttgtgtttggttgaaaaaagtttgcatataagtgaaacttagcatttcaaacctgtgttgttcaaagatcatttgtatttctcttcaagaacaatgaatgtcttcattaaatcatcttttgtgggagagcttttggtttcatagattttcatatatatatatgatataataaacactttttgacattcaaaaaaaaa

SEQ ID NO: 736620 - DNA, 1340 bp, Homo sapiens
atttacctcaaccaaccgcatctcaacaaattccgcgacaaccagatcagtacggccaagtacaacgtgttgacatttctacctcgattcttgtatgagcagattagaagagctgctaatgccttctttctcttcattgccttattacagcaaattccagatgtatctccaacaggaagatataccaccctggtgccattgatcattattttaacaattgcaggcatcaaagagattgtagaagattttaagcgacacaaggcagacaatgcagttaacaaaaagaaaacaatagtgttaagaaatggtatgtggcataccattatgtggaaagaggtggcagtgggagacattgtgaaggtcgtcaatgggcagtatcttccagcagatgtggtcctgctgtcatccagtgaacctcaggcaatgtgttatgttgaaacagctaatctggatggggagacgaaccttaaaatacgtcagggtttgagtcacactgctgacatgcaaacacgtgaagttctgatgaagttatctggaactatagagtgtgaagggcccaaccgccacctctatgacttcactggaaacttgaacttagatgggaaaagccttgttgcccttgggcctgaccagatcttattaagaggtacacagcttagaaatactcagtgggtctttggcatagttgtttatactggacacgacaccaaactcatgcagaattcaaccaaagcgcctctcaagagatcaaatgttgagaaggtgactaacgtgcagatcctggtgttgtttggcatcctcttggtcatggccttggtgagctcggcgggggccctgtactggaacaggtctcatggtgaaaagaactggtacatcaagaagatgggtaagtgtcggggtgggttgcttgttccagtggaagaaaaccatttttgagatgttcttgcagccatggttgaagtgtggtgtccctgctgtccttctgttccctttggttactgtacataatgccagcctttcaaggagaattgagattaggatcatgtgatgaaatgaagatgggcacatttgggacttgtcttatactcaaatggttatttttaaactctgtgttaaagtattttcttagtggttgccctaggaattacaatgtatttcccaatttatccaaatctacttttgattaatactaacaattctagtcaaacacagaaatgtcactccagcgtacctccatttcctctcctgcttggtgctgtcattgttatattccatttatctgtgttgtcaactccaaaatagtgttataataatttgtgtctcttaaagaagctaaagga

SEQ ID NO: 736621 - DNA, 968 bp, Homo sapiens
atttacctcaaccaaccgcatctcaacaaattccgcgacaaccagatcagtacggccaagtacaacgtgttgacatttctacctcgattcttgtatgagcagattagaagagctgctaatgccttctttctcttcattgccttattacagcaaattccagatgtatctccaacaggaagatataccaccctggtgccattgatcattattttaacaattgcaggcatcaaagagattgtagaagattttaagcgacacaaggcagacaatgcagttaacaaaaagaaaacaatagtgttaagaaatggtatgtggcataccattatgtggaaagaggtggcagtgggagacattgtgaaggtcgtcaatgggcagtatcttccagcagatgtggtcctgctgtcatccagtgaacctcaggcaatgtgttatgttgaaacagctaatctggatggggagacgaaccttaaaatacgtcagggtttgagtcacactgctgacatgcaaacacgtgaagttctgatgaagttatctggaactatagagtgtgaagggcccaaccgccacctctatgacttcactggaaacttgaacttagatgggaaaagccttgttgcccttgggcctgaccagatcttattaagaggtacacagcttagaaatactcagtgggtctttggcatagttgtttatactggacacgacaccaaactcatgcagaattcaaccaaagcgcctctcaagagatcaaatgttgagaaggtgactaacgtgcagatcctggtgttgtttggcatcctcttggtcatggccttggtgagctcggcgggggccctgtactggaacaggtctcatggtgaaaagaactggtacatcaagaagatggacaccacctcagataattttggatacaacctactgacgttcatcatcttatacaacaatcttattcccatcagtctgttggt

SEQ ID NO: 736622 - DNA, 743 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcgggggtggctcgggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggttcatagtggcgtcatgcacgcagactcctgcaagttcccctaagttcttagaggactgctttgcctttgatctgagagttgcaaagttccataaagaatggcccttgttggataagcacaaagtcaagagacagcgattggacagaattgtgagg

SEQ ID NO: 736623 - DNA, 929 bp, Homo sapiens; identical to SEQ ID NO: 358492

SEQ ID NO: 736624 - DNA, 404 bp, Homo sapiens
aattcgagctcgggtacacggaatgtgtggtgttatggtgacaagtagagctggtcatgtcgacagccccctcttacctcgtcgcgtctcagcagatgtccatggggtcgtattgggagtgacttttgtaccagttggcttggctgattttggaaagagtggaagaacccccttcaccttgtgagttttgttcatctgtgttgcatgtgtttgcacagtgtacattgactgaaacgtgaagaaacagcccttgggcttttgagtctcggttttctttcttggcgctcatgctctcagaataataatacgtgtggtgcaggcccggtgcaccaggcaagtgagggctgtgctggcatggtttctttaggaggaaggcctgttgcataacaccacaagtttccggg

SEQ ID NO: 736625 - DNA, 666 bp, Homo sapiens
tgaccgttagggacgaggggcttcaaggagcggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaagtcgccacagcgagatcgactgaacggcgcacaccgtgcgcacacacccggggggcacttgagataagcggcatgacgtcggacggcccagggacatgcacgggaaaagaaagtagcgacaatcgctgagaggcacctggccaacgagtaggcattcatgtgaccgcgcaagacaagaaggacaacgcagaaaagtcggaacggaagaaaacgggaagcactaaagaacaggaagcgcccaggaggaggaagcacaggccgaagtggaattggatgtaacacaaaagacgaccaaaaatctcaagcaccacttaccgacgaaacagaggacacaggagaacccattgggagacgcaaaaagaattaccaagaagggccacccattgcaaaacaaggctgcaatcaggcaagaaagggagaagacagcagcaaaaagggggcggcaaagggaagcaaagaaaggcgggaaaaaaatag

SEQ ID NO: 736626 - DNA, 2460 bp, Homo sapiens
ggacctggcaggctggggacagcctcctctccgggactgagctgtaaggaacagacctctctggctatcgttggggagtgaggcaaagttaccgtgagtcttatgttttgtctgctaaggtttcggaggattaataattcaggccatgctttgaaacagaaaacccccagttggttgtccctgccgtctcggaagggttagcacacagccaggtctgtttttgatgtatgtaattgaagatttataaagaaaagcttctcctctgcctcatccacagtcattttttttccaatgccagttcccagcaggcatataaatattggtcgttctcagagctgggatgctgctgggtggtacgagggcccctgggagaacgccgagtccctgcggcctctggggaggagaagctccctgacgtatggcacagcagaggggacttggtttgagccaaaccaccgaccacaggacgctgccctgcccgtggccgccgagccctacctgtaccgggaggccgtttataactcagtggctgcaagaaaggggtctactcctgacttcaccttctacgacagcagacaggcagtgatgtctggtcgcagccccctgctgccacgggagtactacagtgatccgtctggagctgctagggtacccaaagagcctcccctctatcgggacccaggagtcagccggccggtccccagctacggagtgcttggcagcagaacgtcatgggatccaatgcaaggccggtcacctgccctgcaggacgccggtcacctgtaccgggatcctggaggtaaaatgatccctcaggggcggcagacacagagcagggctgcatctcccgggcggtatggacgggagcagcccgacaccaggtatggggcggaggtgcctgcctaccccctcagccaggtcttcagcgacatcagcgaaagacccattgaccctgcccctgccagacaggtggccccgacgtgcctggttgtggaccccagttcagctgctgcccccgaaggcagcacaggggtggccccaggggccctgaatcgtggctacgggcctgcccgggaaagcatcccatccaagatggcttacgagacttacgaagctgacctgtccaccttccagggtcctggtggcaagaggaccgtgctccctgagttcctggcctttctgcgggcggaggggctggcagaggccacgctgggagccctactgcagcagggctttgactccccggccgtcctggctaccctggaggacgcggatatcaagtctgtcgcacccaacctgggccaggcccgtgttctgagccgcctggccaatagctgcaggaccgaaatgcagctgcggaggcaggaccgggggggcccgctgccccgggcgcggtccagcagcttcagccaccgaagcgaactgctccatggtgacttggcttctctgggcgctgcggctcctctgcagacagcatccccccgagctggagacccggctcgccgtccctccagcgcaccatctcagcacctcctggagacggcagccacctattctgcccctggcgtgggcacccatgccccacacttcccctccaactccgggtacagctctcccaccccttgcgccctgacagcgcgtctgagccccacgcaccccctgcaggcaggggtggccttgactaacccgggcccctcaaacccccttcacccaggccccagaacagcttactccacggcatacacggtgcccatggagctgctaaagagggagcgcaacgtggccgcctctccgctgcccagccctcacggcagcccccaggtcttgcggaagccaggtgcacccctggggccatccaccctgccgccggccagccagagcctccacacgcctcactcaccgtacgagaaggtggcccggcgcacaggggcacccatcatcgtgtccaccatgcttgcaccagaaccaagtgcggctcccaggatgactgaagctggtcacttggtagtcccactgactccgctctgtgaggccgactcgaccgtgaccagtgacagagccaaaagatctcacactgatgagagaaagttcctcacataccatgagatagcgatcatagacggcatctctccttgacacttttcttgtccaacagcggcaacgccctcagcagacgaatctatgatcacacagcaaaacagaggttacataacccgtgtacctccctcactagggacgccttagctgaaatagtaaccatcaactgcacatcactcccgtctgacttagaggtaccggaaccatgggtaccaagggttcctacaagatcgcgtagaaagcccgatcgagtatccaggaactgggcactgggtcgcattccaccttgcgacgctgacccgtctacgcggacttgcgcgctgaaccccacactcctaattagccggccatcgcaagcgcatg

SEQ ID NO: 736627 - DNA, 524 bp, Homo sapiens
acccagagacagtgaaaaatagatgaactaagagaacaagaatcggatggtcttagtaactagattctggacatatgcatcattgatgttgcagtgtggttccccggaagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcagtgtgcttccggggtaccgagctct

SEQ ID NO: 736628 - DNA, 572 bp, Homo sapiens
ccatggacgtgttcaaagtattttaatgtccaaaatgaactgtttttcctccagtttccatagaaaatataactgacataaaaagtatcccaccactacaaggaaataatccagcaaatgcactcctgggttgaaacagggcagaatgccagctcaccaatgtgaacagtcatgcaggctgtcatgcagggctttccgaagcactgagtccttgtcatagatgccccaggtagcttgtagaactgaatcaagtaggcagtctcctgcagtccggttccaaagtgcatacagtcgactgtccaaacgtgtagccaattccaaggaccagttaataattggagattcttcttctaattctgtacgatggatttaaatacatgttcatttccatacctatgtcattagagaatactcatggggagaagaacctattttctagctataaaatggtttatatgtaatttaccaataaacacctaaataaaattgaccaattgaaatataaacttttgagtacttgaaacatcttctgtctctagaataatttaataaacttttaaattctttacagt

SEQ ID NO: 736629 - DNA, 1954 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacaggtgagaaaaggaactgactttgtctcagcttgtgagcaccacggccccggggccagggagagaagcccaaacttggcggaagcttaacctcccgcagatgctaagtcagggtcagaacaatcagccttctcagcaggaactgtgtacaccgcccccatttcttccaatgcctaatttcatggaacaaacagaagctcctattttaaaagggggtgtgttcggtcagatgtgattgaccacaggtgctaggaactgcctttcattctaaagccatcttaaaaccagaaggcttcccagtcacgtgtggtggcgcacacctgcagtctcagctgctagggaggctgaggtgggagaggtgcttgaagctgggaggtggagattgcagtgagccgagatcacccactgcactccagcctaggccacagagtgagacaatgctgctaccccccgaccccaccccaccaccaaaaa

SEQ ID NO: 736630 - DNA, 6944 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgtgtgtgtgtgtggtgcgtgtgtgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagttgttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattgttaataaaataaaagcttatttttgttttgctgtggataatcggtacaaaacgtttccagatctgagacttagatggatcttttaaggtgaaaggagaatgccaggttctactgaaataatatctgaaaggaacaaagagccatttgccatgtgctttttctaagtgcccatgctggaaaaaattttctcaataatatgaagatgctggtacaacttttcctattaaacaatgtcttacacaaccacatgcgttacatttatagacagatttacaatttggaaggaaaaaaagttctgtcttaataaaattagttttttttacaaactgtagtccaactaaagttctctgtctcctcacgcagcagaggcattatctccataaggtgtgtgtggtccaggaaaacacttccccgagcagatcctgccagatttggttcattccatgatgtcgactctgcttggagcaccacactaactttagggtcattacagatctgatgccttggtcttctgctgtttgattttttttttcattcatcttcatcatcctcatcttcctctccatcagacagggatgtacacggccggatctgtcggtagcggtcaagccatttttctaccatctgagtgaccagggggtgatttcgccgccgagaactcttctgcatggcaaccagaactcccccctccgtcacacagcagtccagccactccctgagcagtttttcttgctgttcctcattacctagcttttggaggaatatgaagacaaagggaaaatcatacaacagatcagagacttggtaggaatgtgacatggaaacctacagctggtatgctaactcatgaaaaggccaaagcaatcaacttttcacatggttttgacctcttggaagttttgtgattaaagtccagtttgctctggttaaatttaaaaagacataaatgggaaatttctcagaaaaaaactaaagaggagcacactagagggtaatttgttagataaaataaaaaacaaatgtcctaataaactgatcctggcaagccacagcttcaaacacatgacaaggtaagtttacttagtcaattatgtacaagctgaaattacacaagttacggtctatgaactttttttcttcatgttgtgattataaacgttttataattactagtatattaaataaaagaccaatacttttataagaatactggctttctgaaagagcgttgtttttgtaccttctcaccacctcccctgtctggtctacagcaccctttcactccc

SEQ ID NO: 736631 - DNA, 7187 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgtgtgtgtgtgtggtgcgtgtgtgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagttgttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattgttaataaaataaaagcttatttttgttttgctgtggataatcggtacaaaacgtttccagatctgagacttagatggatcttttaaggtgaaaggagaatgccaggttctactgaaataatatctgaaaggaacaaagagccatttgccatgtgctttttctaagtgcccatgctggaaaaaattttctcaataatatgaagatgctggtacaacttttcctattaaacaatgtcttacacaaccacatgcgttacatttatagacagatttacaatttggaaggaaaaaaagttctgtcttaataaaattagttttttttacaaactgtagtccaactaaagttctctgtctcctcacgcagcagaggcattatctccataaggtgtgtgtggtccaggaaaacacttccccgagcagatcctgccagatttggttcattccatgatgtcgactctgcttggagcaccacactaactttagggtcattacagatctgatgccttggtcttctgctgtttgattttttttttcattcatcttcatcatcctcatcttcctctccatcagacagggatgtacacggccggatctgtcggtagcggtcaagccatttttctaccatctgagtgaccagggggtgatttcgccgccgagaactcttctgcatggcaaccagaactcccccctccgtcacacagcagtccagccactccctgagcagtttttcttgctgttcctcattacctagctcctgagcagaaaggaagtgcacatggagtagcttcctttcactgtcaaccagaggcaaaaatgtgatggtgacatcatcatcggtattgagattagcaccagcacctcggttgccatagccatcattttccatggcaaccaaagcagagaagtggcccctcgtataacccagagcaatcggacttttccaacaaaaactctgttcccacaacaaaggcagataaacaccttgaaaccgagtatatcctaaagtttctccccggaaactcttgtaatattttactccataaactataattggtcgtctaagaatatgtgccagtacaaaaatgtgcgtctgctccaagcttgctccaggctgactagcaagagagagtataaatgcccagtcttcttgccattgttcttctctcaaggaaaaatgtaaaccaaagctctgagaataccatgattcccaatctttccagcgtgtgtaaaacctaaaaaagcaggatagtaaaaaaataaataaatagtcttctataaataaaacatttaaagttctgatcatttttatttaatgcagtctttaagcagtctgtgaaacaattaataattttattttgtctggttggtaatgtatttttctaatgaaaaatgcctccctcttccactagcagataccttgtaacatcctttaacatctttagtcagaatttgatttaccgacaaccaaattttcaaacttcaaacgctaatgatgagactggttattttccactgtccacaattagttta

SEQ ID NO: 736632 - DNA, 8722 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgtgtgtgtgtgtggtgcgtgtgtgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagttgttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattgttaataaaataaaagcttatttttgttttgctgtggataatcggtacaaaacgtttccagatctgagacttagatggatcttttaaggtgaaaggagaatgccaggttctactgaaataatatctgaaaggaacaaagagccatttgccatgtgctttttctaagtgcccatgctggaaaaaattttctcaataatatgaagatgctggtacaacttttcctattaaacaatgtcttacacaaccacatgcgttacatttatagacagatttacaatttggaaggaaaaaaagttctgtcttaataaaattagttttttttacaaactgtagtccaactaaagttctctgtctcctcacgcagcagaggcattatctccataaggtgtgtgtggtccaggaaaacacttccccgagcagatcctgccagatttggttcattccatgatgtcgactctgcttggagcaccacactaactttagggtcattacagatctgatgccttggtcttctgctgtttgattttttttttcattcatcttcatcatcctcatcttcctctccatcagacagggatgtacacggccggatctgtcggtagcggtcaagccatttttctaccatctgagtgaccagggggtgatttcgccgccgagaactcttctgcatggcaaccagaactcccccctccgtcacacagcagtccagccactccctgagcagtttttcttgctgttcctcattacctagctcctgagcagaaaggaagtgcacatggagtagcttcctttcactgtcaaccagaggcaaaaatgtgatggtgacatcatcatcggtattgagattagcaccagcacctcggttgccatagccatcattttccatggcaaccaaagcagagaagtggcccctcgtataacccagagcaatcggacttttccaacaaaaactctgttcccacaacaaaggcagataaacaccttgaaaccgagtatatcctaaagtttctccccggaaactcttgtaatattttactccataaactataattggtcgtctaagaatatgtgccagtacaaaaatgtgcgtctgctccaagcttgctccaggctgactagcaagagagagtataaatgcccagtcttcttgccattgttcttctctcaaggaaaaatgtaaaccaaagctctgagaataccatgattcccaatctttccagcgtgtgtaaaaccaatgtgaacagtcatgcaggctgtcatgcagggctttccgaagcactgagtccttgtcatagatgccccaggtagcttgtagaactgaatcaagtaggcagtctcctgcagtccggttccaaagtgcatacagtcgactgtccaaacgtgtagccaattccaaggaccagttaataattggagattcttcttctaattctttttgaacgtctctatcaagcacctcatcaaataatttttcttggactgttgggggcaaatcttcaatatctgctggcaatgtaaatgttacaaggtcagtcagaatatagcaagcaaaatccccctttctctgatgaagagaggcagctatctctctccggatttgttctgtcagttcaggacacaccattgctggaatacactttgctgcttgttgagacacctctgtaagcaatattgctagcatatcctgcctctgaaaacgtatagccaagtgtacaagagtatagccaacatcaaaggcagaaggacgattcagcaagcgtacttcatctgcggtgagctgacgtgcaatgtctcctcctgatgacttgtatgcttctatggcagctaaatcaccttctacaacccccacacaagcattgaggaagagccaatcagtctttttcatcctgtttttaatttgctttagttttttaaagtctacttcaagttcctccttgcttcccacagcaccagccaattcaatcctctgaaaatccattttcacttcagagtcccgcttcgtagcaggaggtgatctcctttggctattaccactactgcaacttcccctccatcgagctctgtcttgctcatttattattgaagaagcctcttcagtctctgccaattctattgcttcaatgttattaggtctgggatgatcacaaacaacacatcttttagccttggcccagttttcatatgtgcaaacagagcaagtccagtgctgtgtcctagtgttcagtttatttctatcattgtattcctcacaaggatcaacagaaaaagcaactggtcttgagccagatcctgaggactgaggagattctgtaggactcctggtcctacgttgggataagcactgggtacatctgattgctcttggccagttcaaatatgtacacatgtggcatgaccacttatttgcattttccatgctatacgaagatttcacccttggtcttgcactagagtctggacatatcaaaggactacttcctccttcggtgctggaaggatcccaatctctaccaacatcacttgaaccacttttaaatggatcttctgtaataattgttccactaggtctttgggcacgacacatagtacacttgattgcagatggccagttttcatacgtacaatattcacaagcccacttaattccacgttctgacattgtgcacttcttgaagtgagctgtgtcaggcaggaagctataaataattaggacatggttattaaaataactacattccacctccaaaaatacgctgcccaaaaagcaagtccttcaacctacaaaatataaatttctcaaaagatgcatgcaacatttcgacattgaattatcctaattttcttttttaatttccatagaaacactggagataaattctcaaagaaaaaatcttagaccctgggatttaataaaactgaactttggaatgcaaaagagataggcaggagatataacgaggtttgatctaagaaggatgagattaacgggaagccactaatagaaatgtttaatttcagggaggccatcaccccgcgtactctgcgttgttaccactgcttaagcc

SEQ ID NO: 736633 - DNA, 8494 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgtgtgtgtgtgtggtgcgtgtgtgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagttgttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattgttaataaaataaaagcttatttttgttttgctgtggataatcggtacaaaacgtttccagatctgagacttagatggatcttttaaggtgaaaggagaatgccaggttctactgaaataatatctgaaaggaacaaagagccatttgccatgtgctttttctaagtgcccatgctggaaaaaattttctcaataatatgaagatgctggtacaacttttcctattaaacaatgtcttacacaaccacatgcgttacatttatagacagatttacaatttggaaggaaaaaaagttctgtcttaataaaattagttttttttacaaactgtagtccaactaaagttctctgtctcctcacgcagcagaggcattatctccataaggtgtgtgtggtccaggaaaacacttccccgagcagatcctgccagatttggttcattccatgatgtcgactctgcttggagcaccacactaactttagggtcattacagatctgatgccttggtcttctgctgtttgattttttttttcattcatcttcatcatcctcatcttcctctccatcagacagggatgtacacggccggatctgtcggtagcggtcaagccatttttctaccatctgagtgaccagggggtgatttcgccgccgagaactcttctgcatggcaaccagaactcccccctccgtcacacagcagtccagccactccctgagcagtttttcttgctgttcctcattacctagctcctgagcagaaaggaagtgcacatggagtagcttcctttcactgtcaaccagaggcaaaaatgtgatggtgacatcatcatcggtattgagattagcaccagcacctcggttgccatagccatcattttccatggcaaccaaagcagagaagtggcccctcgtataacccagagcaatcggacttttccaacaaaaactctgttcccacaacaaaggcagataaacaccttgaaaccgagtatatcctaaagtttctccccggaaactcttgtaatattttactccataaactataattggtcgtctaagaatatgtgccagtacaaaaatgtgcgtctgctccaagcttgctccaggctgactagcaagagagagtataaatgcccagtcttcttgccattgttcttctctcaaggaaaaatgtaaaccaaagctctgagaataccatgattcccaatctttccagcgtgtgtaaaaccaatgtgaacagtcatgcaggctgtcatgcagggctttccgaagcactgagtccttgtcatagatgccccaggtagcttgtagaactgaatcaagtaggcagtctcctgcagtccggttccaaagtgcatacagtcgactgtccaaacgtgtagccaattccaaggaccagttaataattggagattcttcttctaattctttttgaacgtctctatcaagcacctcatcaaataatttttcttggactgttgggggcaaatcttcaatatctgctggcaatgtaaatgttacaaggtcagtcagaatatagcaagcaaaatccccctttctctgatgaagagaggcagctatctctctccggatttgttctgtcagttcaggacacaccattgctggaatacactttgctgcttgttgagacacctctgtaagcaatattgctagcatatcctgcctctgaaaacgtatagccaagtgtacaagagtatagccaacatcaaaggcagaaggacgattcagcaagcgtacttcatctgcggtgagctgacgtgcaatgtctcctcctgatgacttgtatgcttctatggcagctaaatcaccttctacaacccccacacaagcattgaggaagagccaatcagtctttttcatcctgtttttaatttgctttagttttttaaagtctacttcaagttcctccttgcttcccacagcaccagccaattcaatcctctgaaaatccattttcacttcagagtcccgcttcgtagcaggaggtgatctcctttggctattaccactactgcaacttcccctccatcgagctctgtcttgctcatttattattgaagaagcctcttcagtctctgccaattctattgcttcaatgttattaggtctgggatgatcacaaacaacacatcttttagccttggcccagttttcatatgtgcaaacagagcaagtccagtgctgtgtcctagtgttcagtttatttctatcattgtattcctcacaaggatcaacagaaaaagcaactggtcttgagccagatcctgaggactgaggagattctgtaggactcctggtcctacgttgggataagcactgggtacatctgattgctcttggccagttcaaatatgtacacatgtggcatgaccacttatttgcattttccatgctatacgaagatttcacccttggtcttgcactagagtctggacatatcaaaggactacttcctccttcggtgctggaaggatcccaatctctaccaacatcacttgaaccacttttaaatggatcttctgtaataattgttccactaggtctttgggcacgacacatagtacacttgattgcagatggccagttttcatacgtacaatattcacaagcccacttaattccacgttctgacattgtgcacttcttgaagtgagctgtgtcaggcaggaagctggcggcggcggctcctcctccagctcctgctcctcctccccgtccgacgggcgcttggcggcggcggcggcggcggcggcttttatataattatcaactacccgcacaacccgcggctacgagttgagcccagaccctc

SEQ ID NO: 736634 - DNA, 6833 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgtgtgtgtgtgtggtgcgtgtgtgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagttgttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattgttaataaaataaaagcttatttttgttttgctgtggataatcggtacaaaacgtttccagatctgagacttagatggatcttttaaggtgaaaggagaatgccaggttctactgaaataatatctgaaaggaacaaagagccatttgccatgtgctttttctaagtgcccatgctggaaaaaattttctcaataatatgaagatgctggtacaacttttcctattaaacaatgtcttacacaaccacatgcgttacatttatagacagatttacaatttggaaggaaaaaaagttctgtcttaataaaattagttttttttacaaactgtagtccaactaaagttctctgtctcctcacgcagcagaggcattatctccataaggtgtgtgtggtccaggaaaacacttccccgagcagatcctgccagatttggttcattccatgatgtcgactctgcttggagcaccacactaactttagggtcattacagatctgatgccttggtcttctgctgtttgattttttttttcattcatcttcatcatcctcatcttcctctccatcagacagggatgtacacggccggatctgtcggtagcggtcaagccatttttctaccatctgagtgaccagggggtgatttcgccgccgagaactcttctgcatggcaaccagaactcccccctccgtcacacagcagtccagccactccctgagcagtttttcttgctgttcctcattacctagctcctgagcagaaaggaagtgcacatggagtagcttcctttcactgtcaaccagaggcaaaaatgtgatggtgacatcatcatcggtattgagattagcaccagcacctcggttgccatagccatcattttccatggcaaccaaagcagagaagtggcccctcgtataacccagagcaatcggacttttccaacaaaaactctgttcccacaacaaaggcagataaacaccttgaaaccgagtatatcctaaagtttctccccggaaactcttgtaatattttactccataaactataattggtcgtctaagaatatgtgccagtacaaaaatgtgcgtctgctccaagcttgctccaggctgactagcaagagagagtataaatgcccagtcttctgatccaaaggattcgggacctgtaccag

SEQ ID NO: 736635 - DNA, 6097 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgtgtgtgtgtgtggtgcgtgtgtgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagttgttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattgttaataaaataaaagcttatttttgttttgctgtggataatcggtacaaaacgtttccagatctgagacttagatggatcttttaaggtgaaaggagaatgccaggttctactgaaataatatctgaaaggaacaaagagccatttgccatgtgctttttctaagtgcccatgctggaaaaaattttctcaataatatgaagatgctggtacaacttttcctattaaacaatgtcttacacaaccacatgcgttacatttatagacagatttacaatttggaaggaaaaaaagttctgtcttaataaaattagttttttttacaaactgtagtccaactaaagttctctgtctcctcacacaccttatggagataatgcctctgctgcgtgaggagacagagaactttagttggactacagttttttttacaaactgta

SEQ ID NO: 736636 - DNA, 7667 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgtgtgtgtgtgtggtgcgtgtgtgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagttgttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaactgtttgattttttttttcattcatcttcatcatcctcatcttcctctccatcagacagggatgtacacggccggatctgtcggtagcggtcaagccatttttctaccatctgagtgaccagggggtgatttcgccgccgagaactcttctgcatggcaaccagaactcccccctccgtcacacagcagtccagccactccctgagcagtttttcttgctgttcctcattacctagctcctgagcagaaaggaagtgcacatggagtagcttcctttcactgtcaaccagaggcaaaaatgtgatggtgacatcatcatcggtattgagattagcaccagcacctcggttgccatagccatcattttccatggcaaccaaagcagagaagtggcccctcgtataacccagagcaatcggacttttccaacaaaaactctgttcccacaacaaaggcagataaacaccttgaaaccgagtatatcctaaagtttctccccggaaactcttgtaatattttactccataaactataattggtcgtctaagaatatgtgccagtacaaaaatgtgcgtctgctccaagcttgctccaggctgactagcaagagagagtataaatgcccagtcttcttgccattgttcttctctcaaggaaaaatgtaaaccaaagctctgagaataccatgattcccaatctttccagcgtgtgtaaaaccaatgtgaacagtcatgcaggctgtcatgcagggctttccgaagcactgagtccttgtcatagatgccccaggtagcttgtagaactgaatcaagtaggcagtctcctgcagtccggttccaaagtgcatacagtcgactgtccaaacgtgtagccaattccaaggaccagttaataattggagattcttcttctaattctttttgaacgtctctatcaagcacctcatcaaataatttttcttggactgttgggggcaaatcttcaatatctgctggcaatgtaaatgttacaaggtcagtcagaatatagcaagcaaaatccccctttctctgatgaagagaggcagctatctctctccggatttgttctgtcagttcaggacacaccattgctggaatacactttgctgcttgttgagacacctctgtaagcaatattgctagcatatcctgcctctgaaaacgtatagccaagtgtacaagagtatagccaacatcaaaggcagaaggacgattcagcaagcgtacttcatctgcggtgagctgacgtgcaatgtctcctcctgatgacttgtatgcttctatggcagctaaatcaccttctacaacccccacacaagcattgaggaagagccaatcagtctttttcatcctgtttttaatttgctttagttttttaaagtctacttcaagttcctccttgcttcccacagcaccagccaattcaatcctctgaaaatccattttcacttcagagtcccgcttcgtagcaggaggtgatctcctttggctattaccactactgcaacttcccctccatcgagctctgtcttgctcatttattattgaagaagcctcttcagtctctgccaattctattgcttcaatgttattaggtctgggatgatcacaaacaacacatcttttagccttggcccagttttcatatgtgcaaacagagcaagtccagtgctgtgtcctagtgttcagtttatttctatcattgtattcctcacaaggatcaacagaaaaagcaactggtcttgagccagatcctgaggactgaggagattctgtaggactcctggtcctacgttgggataagcactgggtacatctgattgctcttggccagttcaaatatgtacacatgtggcatgaccacttatttgcattttccatgctatacgaagatttcacccttggtcttgcactagagtctggacatatcaaaggactacttcctccttcggtgctggaaggatcccaatctctaccaacatcacttgaaccacttttaaatggatcttctgtaataattgttccactaggtctttgggcacgacacatagtacacttgattgcagatggccagttttcatacgtacaatattcacaagcccacttaattccacgttctgacattgtgcacttcttgaagtgagctgtgtcaggcaggaagctggcggcggcggctcctcctccagctcctgctcctcctccccgtccgacgggcgcttggcggcggcggcggcggcggcggcttttatataattatcaactacccgcacaacccgcggctacgagttgagcccagaccctc

SEQ ID NO: 736637 - DNA, 8699 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagttgttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattgttaataaaataaaagcttatttttgttttgctgtggataatcggtacaaaacgtttccagatctgagacttagatggatcttttaaggtgaaaggagaatgccaggttctactgaaataatatctgaaaggaacaaagagccatttgccatgtgctttttctaagtgcccatgctggaaaaaattttctcaataatatgaagatgctggtacaacttttcctattaaacaatgtcttacacaaccacatgcgttacatttatagacagatttacaatttggaaggaaaaaaagttctgtcttaataaaattagttttttttacaaactgtagtccaactaaagttctctgtctcctcacgcagcagaggcattatctccataaggtgtgtgtggtccaggaaaacacttccccgagcagatcctgccagatttggttcattccatgatgtcgactctgcttggagcaccacactaactttagggtcattacagatctgatgccttggtcttctgctgtttgattttttttttcattcatcttcatcatcctcatcttcctctccatcagacagggatgtacacggccggatctgtcggtagcggtcaagccatttttctaccatctgagtgaccagggggtgatttcgccgccgagaactcttctgcatggcaaccagaactcccccctccgtcacacagcagtccagccactccctgagcagtttttcttgctgttcctcattacctagctcctgagcagaaaggaagtgcacatggagtagcttcctttcactgtcaaccagaggcaaaaatgtgatggtgacatcatcatcggtattgagattagcaccagcacctcggttgccatagccatcattttccatggcaaccaaagcagagaagtggcccctcgtataacccagagcaatcggacttttccaacaaaaactctgttcccacaacaaaggcagataaacaccttgaaaccgagtatatcctaaagtttctccccggaaactcttgtaatattttactccataaactataattggtcgtctaagaatatgtgccagtacaaaaatgtgcgtctgctccaagcttgctccaggctgactagcaagagagagtataaatgcccagtcttcttgccattgttcttctctcaaggaaaaatgtaaaccaaagctctgagaataccatgattcccaatctttccagcgtgtgtaaaaccaatgtgaacagtcatgcaggctgtcatgcagggctttccgaagcactgagtccttgtcatagatgccccaggtagcttgtagaactgaatcaagtaggcagtctcctgcagtccggttccaaagtgcatacagtcgactgtccaaacgtgtagccaattccaaggaccagttaataattggagattcttcttctaattctttttgaacgtctctatcaagcacctcatcaaataatttttcttggactgttgggggcaaatcttcaatatctgctggcaatgtaaatgttacaaggtcagtcagaatatagcaagcaaaatccccctttctctgatgaagagaggcagctatctctctccggatttgttctgtcagttcaggacacaccattgctggaatacactttgctgcttgttgagacacctctgtaagcaatattgctagcatatcctgcctctgaaaacgtatagccaagtgtacaagagtatagccaacatcaaaggcagaaggacgattcagcaagcgtacttcatctgcggtgagctgacgtgcaatgtctcctcctgatgacttgtatgcttctatggcagctaaatcaccttctacaacccccacacaagcattgaggaagagccaatcagtctttttcatcctgtttttaatttgctttagttttttaaagtctacttcaagttcctccttgcttcccacagcaccagccaattcaatcctctgaaaatccattttcacttcagagtcccgcttcgtagcaggaggtgatctcctttggctattaccactactgcaacttcccctccatcgagctctgtcttgctcatttattattgaagaagcctcttcagtctctgccaattctattgcttcaatgttattaggtctgggatgatcacaaacaacacatcttttagccttggcccagttttcatatgtgcaaacagagcaagtccagtgctgtgtcctagtgttcagtttatttctatcattgtattcctcacaaggatcaacagaaaaagcaactggtcttgagccagatcctgaggactgaggagattctgtaggactcctggtcctacgttgggataagcactgggtacatctgattgctcttggccagttcaaatatgtacacatgtggcatgaccacttatttgcattttccatgctatacgaagatttcacccttggtcttgcactagagtctggacatatcaaaggactacttcctccttcggtgctggaaggatcccaatctctaccaacatcacttgaaccacttttaaatggatcttctgtaataattgttccactaggtctttgggcacgacacatagtacacttgattgcagatggccagttttcatacgtacaatattcacaagcccacttaattccacgttctgacattgtgcacttcttgaagtgagctgtgtcaggcaggaagctataaataattaggacatggttattaaaataactacattccacctccaaaaatacgctgcccaaaaagcaagtccttcaacctacaaaatataaatttctcaaaagatgcatgcaacatttcgacattgaattatcctaattttcttttttaatttccatagaaacactggagataaattctcaaagaaaaaatcttagaccctgggatttaataaaactgaactttggaatgcaaaagagataggcaggagatataacgaggtttgatctaagaaggatgagattaacgggaagccactaatagaaatgtttaatttcagggaggccatcaccccgcgtactctgcgttgttaccactgcttaagcc

SEQ ID NO: 736638 - DNA, 3306 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttaaaaaacaaaaaaaaaacaacaacaaaaaaaaaacactcacactaaccaacaaacaaaaaacaacaacaaaaaacaaagggggggggggctaaaaaatattccccgggggggcccatatggcgccccctttttttttcagggggggcccaagggggggctaattaaacgggggggggcgcggatataaaacaggtgggcagggggggaaccagagcagctatgtgatctttggggaaagaacccacttcgtgtcggctgaaatcgggcccccccccccgaatcacgccgggaacataaaatactgtctattggtgaacacgcatgttgcggggaaattgctcgtttttgaagtggtagtcaataaaacagcacgacaggaggagacgaaggtacgtctgcaaggagctcaacaacaatcatgcactgtcacagcagcaaacgacagaacgtatacagca

SEQ ID NO: 736639 - DNA, 2495 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattgtgaaacttaatactttttttttttttttgcctgtggtagacacctgcacgcataggattgaagacagtacaggtctgctgtacagagaagcgcctctcacatctgaactgcatactgagcgggcaagtcggttgtaagttcagtaaaaccctctgat

SEQ ID NO: 736640 - DNA, 2779 bp, Homo sapiens
  misc_feature (2778)..(2778): n is a, c, g, or t
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaacacgaacactccgagggcctcctaagccgggggcgcggacacaccacgtcaccgaactgggcccagggccatagctggttcttggacccaagtttctgtgtacacaccgggtcacatcagcgggtctccttaagggagccgcataatccaagagagcgtttgagccttagaaactaccgacacaaaacacgggcaaaagagccagctcgcgacacgacatcagagtaatcccggcactatcacactcactgcaacaagcgaaaatcatagcaagcacatataagacacaccacaaccactagctcagctacagacaagaataacacactgctaaccgcacgctgctcgcacgcaccatcactcatcagatgccatacctccccaccagtagaagaacacatacacctgcatctctacagaccgcaacttcagtccacctatagtagacaaagcaaatccagagataggtacctctacaactacagna

SEQ ID NO: 736641 - DNA, 8123 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgtgtgtgtgtgtggtgcgtgtgtgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagttgttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattgttaataaaataaaagcttatttttgttttgctgtggataatcggtacaaaacgtttccagatctgagacttagatggatcttttaaggtgaaaggagaatgccaggttctactgaaataatatctgaaaggaacaaagagccatttgccatgtgctttttctaagtgcccatgctggaaaaaattttctcaataatatgaagatgctggtacaacttttcctattaaacaatgtcttacacaaccacatgcgttacatttatagacagatttacaatttggaaggaaaaaaagttctgtcttaataaaattagttttttttacaaactgtagtccaactaaagttctctgtctcctcacgcagcagaggcattatctccataaggtgtgtgtggtccaggaaaacacttccccgagcagatcctgccagatttggttcattccatgatgtcgactctgcttggagcaccacactaactttagggtcattacagatctgatgccttggtcttctgctgtttgattttttttttcattcatcttcatcatcctcatcttcctctccatcagacagggatgtacacggccggatctgtcggtagcggtcaagccatttttctaccatctgagtgaccagggggtgatttcgccgccgagaactcttctgcatggcaaccagaactcccccctccgtcacacagcagtccagccactccctgagcagtttttcttgctgttcctcattacctagctcctgagcagaaaggaagtgcacatggagtagcttcctttcactgtcaaccagaggcaaaaatgtgatggtgacatcatcatcggtattgagattagcaccagcacctcggttgccatagccatcattttccatggcaaccaaagcagagaagtggcccctcgtataacccagagcaatcggacttttccaacaaaaactctgttcccacaacaaaggcagataaacaccttgaaaccgagtatatcctaaagtttctccccggaaactcttgtaatattttactccataaactataattggtcgtctaagaatatgtgccagtacaaaaatgtgcgtctgctccaagcttgctccaggctgactagcaagagagagtataaatgcccagtcttcttgccattgttcttctctcaaggaaaaatgtaaaccaaagctctgagaataccatgattcccaatctttccagcgtgtgtaaaaccaatgtgaacagtcatgcaggctgtcatgcagggctttccgaagcactgagtccttgtcatagatgccccaggtagcttgtagaactgaatcaagtaggcagtctcctgcagtccggttccaaagtgcatacagtcgactgtccaaacgtgtagccaattccaaggaccagttaataattggagattcttcttctaattctttttgaacgtctctatcaagcacctcatcaaataatttttcttggactgttgggggcaaatcttcaatatctgctggcaatgtaaatgttacaaggtcagtcagaatatagcaagcaaaatccccctttctctgatgaagagaggcagctatctctctccggatttgttctgtcagttcaggacacaccattgctggaatacactttgctgcttgttgagacacctctgtaagcaatattgctagcatatcctgcctctgaaaacgtatagccaagtgtacaagagtatagccaacatcaaaggcagaaggacgattcagcaagcgtacttcatctgcggtgagctgacgtgcaatgtctcctcctgatgacttgtatgcttctatggcagctaaatcaccttctacaacccccacacaagcattgaggaagagccaatcagtctttttcatcctgtttttaatttgctttagttttttaaagtctacttcaagttcctccttgcttcccacagcaccagccaattcaatcctctgaaaatccattttcacttcagagtcccgcttcgtagcaggaggtgatctcctttggctattaccactactgcaacttcccctccatcgagctctgtcttgctcatttattattgaagaagcctcttcagtctctgccaattctattgcttcaatgttattaggtctgggatgatcacaaacaacacatcttttagccttggcccagttttcatatgtgcaaacagagcaagtccagtgctgtgtcctagtgttcagtttatttctatcattgtattcctcacaaggatcaacagaaaaagcaactggtcttgagccagatcctgaggactgaggagattctgtaggactcctggtcctacgttgggataagcactgggtacatctgattgctcttggccagttcaaatatgtacacatgtggcatgaccacttatttgcattttccatgctatacgaagatttcacccttggtcttgcactagagtctggacatatcaaaggactacttcctccttcggtgctggaaggatcccaatctctaccaacatcacttgaaccacttttaaatggatcttctgtaataattgttccactaggtctttgggcacgacacatagtacacttgattgcagatggccagttttcatacgtacaatattcacaagcccacttaattccacgttctgacattgtgcacttcttgaagtgagctgtgtcaggcaggaagctataaataattaggacatggttattaaaataactacattccacctccaaaaatacgctgcccaaaaagcaagtccttcaacctacaaaatataaatttctcaaaagatgcatgcaacatttcgacattgaattatcctaattttcttttttaatttccatagaaacactggagataaattctcaaagaaaaaatcttagaccctgggatttaataaaactgaactttggaatgcaaaagagataggcaggagatataacgaggtttgatctaagaaggatgagattaacgggaagccactaatagaaatgtttaatttcagggaggccatcaccccgcgtactctgcgttgttaccactgcttaagcc

SEQ ID NO: 736642 - DNA, 8604 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgtgtgtgtgtgtggtgcgtgtgtgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagttgttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattgttaataaaataaaagcttatttttgttttgctgtggataatcggtacaaaacgtttccagatctgagacttagatggatcttttaaggtgaaaggagaatgccaggttctactgaaataatatctgaaaggaacaaagagccatttgccatgtgctttttctaagtgcccatgctggaaaaaattttctcaataatatgaagatgctggtacaacttttcctattaaacaatgtcttacacaaccacatgcgttacatttatagacagatttacaatttggaaggaaaaaaagttctgtcttaataaaattagttttttttacaaactgtagtccaactaaagttctctgtctcctcacgcagcagaggcattatctccataaggtgtgtgtggtccaggaaaacacttccccgagcagatcctgccagatttggttcattccatgatgtcgactctgcttggagcaccacactaactttagggtcattacagatctgatgccttggtcttctgctgtttgattttttttttcattcatcttcatcatcctcatcttcctctccatcagacagggatgtacacggccggatctgtcggtagcggtcaagccatttttctaccatctgagtgaccagggggtgatttcgccgccgagaactcttctgcatggcaaccagaactcccccctccgtcacacagcagtccagccactccctgagcagtttttcttgctgttcctcattacctagctcctgagcagaaaggaagtgcacatggagtagcttcctttcactgtcaaccagaggcaaaaatgtgatggtgacatcatcatcggtattgagattagcaccagcacctcggttgccatagccatcattttccatggcaaccaaagcagagaagtggcccctcgtataacccagagcaatcggacttttccaacaaaaactctgttcccacaacaaaggcagataaacaccttgaaaccgagtatatcctaaagtttctccccggaaactcttgtaatattttactccataaactataattggtcgtctaagaatatgtgccagtacaaaaatgtgcgtctgctccaagcttgctccaggctgactagcaagagagagtataaatgcccagtcttcttgccattgttcttctctcaaggaaaaatgtaaaccaaagctctgagaataccatgattcccaatctttccagcgtgtgtaaaaccaatgtgaacagtcatgcaggctgtcatgcagggctttccgaagcactgagtccttgtcatagatgccccaggtagcttgtagaactgaatcaagtaggcagtctcctgcagtccggttccaaagtgcatacagtcgactgtccaaacgtgtagccaattccaaggaccagttaataattggagattcttcttctaattctttttgaacgtctctatcaagcacctcatcaaataatttttcttggactgttgggggcaaatcttcaatatctgctggcaatgtaaatgttacaaggtcagtcagaatatagcaagcaaaatccccctttctctgatgaagagaggcagctatctctctccggatttgttctgtcagttcaggacacaccattgctggaatacactttgctgcttgttgagacacctctgtaagcaatattgctagcatatcctgcctctgaaaacgtatagccaagtgtacaagagtatagccaacatcaaaggcagaaggacgattcagcaagcgtacttcatctgcggtgagctgacgtgcaatgtctcctcctgatgacttgtatgcttctatggcagctaaatcaccttctacaacccccacacaagcattgaggaagagccaatcagtctttttcatcctgtttttaatttgctttagttttttaaagtctacttcaagttcctccttgcttcccacagcaccagccaattcaatcctctgaaaatccattttcacttcagagtcccgcttcgtagcaggaggtgatctcctttggctattaccactactgcaacttcccctccatcgagctctgtcttgctcatttattattgaagaagcctcttcagtctctgccaattctattgcttcaatgttattaggtctgggatgatcacaaacaacacatcttttagccttggcccagttttcatatgtgcaaacagagcaagtccagtgctgtgtcctagtgttcagtttatttctatcattgtattcctcacaaggatcaacagaaaaagcaactggtcttgagccagatcctgaggactgaggagattctgtaggactcctggtcctacgttgggataagcactgggtacatctgattgctcttggccagttcaaatatgtacacatgtggcatgaccacttatttgcattttccatgctatacgaagatttcacccttggtcttgcactagagtctggacatatcaaaggactacttcctccttcggtgctggaaggatcccaatctctaccaacatcacttgaaccacttttaaatggatcttctgtaataattgttccactaggtctttgggcacgacacatagtacacttgattgcagatggccagttttcatacgtacaatattcacaagcccacttaattccacgttctgacattgtgcacttcttgaagtgagctgtgtcaggcaggaagctataaataattaggacatggttattaaaataactacattccacctccaaaaatacgctgcccaaaaagcaagtccttcaacctacaaaatataaatttctcaaaagatgcatgcaacatttcgacattgaattatcctaattttcttttttaatttccatagaaacactggagataaattctcaaagaaaaaatcttagaccctgggatttaataaaactgaactttggaatgcaaaagagataggcaggagatataacgaggtttgatctaagaaggatgagattaacgggaagccactaatagaaatgtttaatttcagggaggccatcaccccgcgtactctgcgttgttaccactgcttaagcc

SEQ ID NO: 736643 - DNA, 1256 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcagatgagattcgggcatctttcaacgacatgacaaagtgaaggctctactatgcacgtcaggcgcg

SEQ ID NO: 736644 - DNA, 6867 bp, Homo sapiens
ggtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgtgtgtgtgtgtggtgcgtgtgtgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagttgttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattgttaataaaataaaagcttatttttgttttgctgtggataatcggtacaaaacgtttccagatctgagacttagatggatcttttaaggtgaaaggagaatgccaggttctactgaaataatatctgaaaggaacaaagagccatttgccatgtgctttttctaagtgcccatgctggaaaaaattttctcaataatatgaagatgctggtacaacttttcctattaaacaatgtcttacacaaccacatgcgttacatttatagacagatttacaatttggaaggaaaaaaagttctgtcttaataaaattagttttttttacaaactgtagtccaactaaagttctctgtctcctcacgcagcagaggcattatctccataaggtgtgtgtggtccaggaaaacacttccccgagcagatcctgccagatttggttcattccatgatgtcgactctgcttggagcaccacactaactttagggtcattacagatctgatgccttggtcttctgctgtttgattttttttttcattcatcttcatcatcctcatcttcctctccatcagacagggatgtacacggccggatctgtcggtagcggtcaagccatttttctaccatctgagtgaccagggggtgatttcgccgccgagaactcttctgcatggcaaccagaactcccccctccgtcacacagcagtccagccactccctgagcagtttttcttgctgttcctcattacctagcttttggaggaatatgaagacaaagggaaaatcatacaacagatcagagacttggtaggaatgtgacatggaaacctacagctggtatgctaactcatgaaaaggccaaagcaatcaacttttcacatggttttgacctcttggaagttttgtgattaaagtccagtttgctctggttaaatttaaaaagacataaatgggaaatttctcagaaaaaaactaaagaggagcacactagagggtaatttgttagataaaataaaaaacaaatgtcctaataaactgatcctggcaagccacagcttcaaacacatgacaaggtaagtttacttagtcaattatgtacaagctgaaattacacaagttacggtctatgaactttttttcttcatgttgtgattataaacgttttataattactagtatattaaataaaagaccaatacttttataagaatactggctttctgaaagagcgttgtttttgtaccttctcaccacctcccctgtctggtctacagcaccctttcactccc

SEQ ID NO: 736645 - DNA, 720 bp, Homo sapiens
ctacattcccaaggctgatttccaacgactcaccggtagccatatggattactatttaagataactgaagacgactgtatcattgagattaagaccacagactcagaaaaaggaatagaaaataaacaacaacaaaaaccaaagaaacaaaaacaaacaaaaaagatcacacagtctgaaaaggaatgcttgggttcaatcccaaatccacctcttactatcagttgaataacttcgggaaagtatttaataacataaactctgcctaatttcctcataacaaaataacaagacctacttcatcaatagctatggtccacagacgaatgccttaaaatcaaagtggtaagatgttattggtaatactcatttccaagtagttttcctacccactctcacatttattcaacaaatatttcatcatttttcagtagtaacttactgagtgacggaaacttgattaactgaaaggacagaaaatggaacaacaaagtgcgttcaagagcaggtacctggggctatgctgggagaagccaagaagtccctccttcctcctctttgcaaattcggaggcggtgaataaaaggatgctgtcagcacgatggagtctctatcccggataaacggcggtaaacatccccacgcattggagcccgatgactcaatcctcccggacccaaaagatggtggcggcctcgctttccggggcggaagtcggct

SEQ ID NO: 736646 - DNA, 722 bp, Homo sapiens; identical to SEQ ID NO: 262127

SEQ ID NO: 736647 - DNA, 1468 bp, Homo sapiens
ttccgctccaggaaggcgaggtcggatctgagatatctcccagggaggttcacttccccggaactctgccttttcccagaaggaggaggggaaaaatgaccaagttccaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcagaaacctgaatagagtcaccttgtaataactgggaactcttcccctgaagacacctggttaattcacttgcaacctgtttccagatttgccagcaggacagctcttgatttgaaagggttttgcaactgcagcactactattttggactggccaattctctgttgggggcactgtcctgtgcactgtaggagattttgcagaattcctggatactacccacaaaatgccaatagcacccctctgtcaggtgtgacaaccatttccagacattgccaaatatcttctgggggcgaaatcacccatggttgagaaccagcaatttaaaaggacagaattttgcctgagcagaaagaccagaaaaacctatcctgttttcccagggattagaaaaccttttgtcttcaagagcaaagaaccattttaaaaggtccaaacccttaaacacctgagagcaaagagattctcaagggaactgaagttcagggtcagagagtgcctgtcctcacccactgcaaccaggttcttgaagttctccaccatgacatctcggtacagcttcctctgggtaagatcgagcagtcgcagttcctccctggagaagaccacagccacatccttgaatgtcacagcctcctacaatatcaaacacatgtaacctcaatcttacaaccaaccttcactagaagaagggtggcatcaagaaggaaaagagcaccacaaaaaagttgttatagattccaagagatctcagtcaattttcagctgttacagttttccctgtctcactatctcctacgctcatccccataaagcctgtagtttatcactgttttttgtttttttcttttttgagatggagtctcactctgtcacccgactccagcctgggtgacaggggtgagacactgtcttaaaataaataaatttttagaattaaaataaatagatcataaagtgtttgaaaggatcagatgaatgaatatatgtcaagcacttagaagtgcctagcacaccatacatgctcaataaactcgaacaacgcatatctttatcatctcttttgtcctattttgtgactacatacaacaggattccttggaactgaagatttatctctaaccaatccaaataatgt

SEQ ID NO: 736648 - DNA, 321 bp, Homo sapiens
gtctcgactgtcacccaggctggagtgcagtggcgcaatcttggctcactgcaacctccgcttctccagcctgggtgacaggggtgagacactgtcttaaaataaataaatttttagaattaaaataaatagatcataaagtgtttgaaaggatcagatgaatgaatatatgtcaagcacttagaagtgcctagcacaccatacatgctcaataaactcgaacaacgcatatctttatcatctcttttgtcctattttgtgactacatacaacaggattccttggaactgaagatttatctctaaccaatccaaataatgt

SEQ ID NO: 736649 - DNA, 2240 bp, Homo sapiens
ttttttttttacagaaaatttttagtaattttattcatttttcatagctttacagcttttatgaaaataatgatcactgtaagtataaaatgaaaattaaagaaaagggataataacccaaaactctccctggccaaaaaaccagttagcatatggcaaatatccttccacacattatcttcaggcatatattcacaatgaaaggtgatcatttatattaactagatcttaccaagagagccaccagccctatttctcccctaaatacgagttctattcctgttcatggttctgtgttatcatcttgatggatttgttagaaagattccaagtgtgaacaaacccccttccactctcagtagttttacagggtttaccaccagcatggactagccaaaaacttgaagatgtgcattcagacaaaagttggtaacacatttctcatttctaaagctttttaccagtatggactttctgatgatatgtaagacgtgaacggtgacggaagtccttatcacatatgtcacatttgtatggtttttctccagtgtggactctctgatgggcttcaagacgtgcactctgactgaagcctttaccacactcttcacatttaaagagtttttccctggtgtgaacacccaggtggactcgaagatttgaggggagactgaaggccttaccacactcctcacatatatggggtttctctcccgtgtggaccctctgatgatggcgaagattcaagctcctaccaaagcctttcccacactcttcacatttgtaaggtttttctccagtgtggcctctctgatggtatataaactgcgaactgtatctaaagccctttccacacacatcacatttgtatggcttttcccccgtgtggactctctgatgggattgaagaccagaggactgactgaagcccttaccacagacaccacatttgtatggcttctctccagtatggactctctgatgtacccgaaaatctatggcctgactgaagctcttatcacactgctcacatttatagggtttttctcctgagtgaactctttgatgtgcatgaagatttgatctccaactgaagcccttcccacattcctcacatttatatggtttttctccagtgtgaattacttggtgtagtttaagatttgaactataactgaagtccttaccacacacatcacatctatatggtttctctccagtgtggactcgctgatgggtttgaagctttgaggactgactgaagcccttcccacacgtttcacacttgaatcgtttctccccagtgtggacattctgatggacttgaagatttgaagcctgactgaagcccttaccacactccttacatttatagggtttctctcccgtgtgaactctgaaatgaatatgcagatctgtattacgggtaaagcctttcccacacgcctcacacttgtatggcttctctcctgtgtggactctccgatggcatattaatggtgaattgtggctgaagcccttaccacacacatcacacttgtagggtttctctccagtgtggactctctgatggatgtgaaaatgtgcagcctgagtgaagcccttaccacattcctcacatttatagggcttctcacccctgtggaccctctggtgaacacggagattaacactccaaccgaagcccttaccacactcttcgcatttgtatggtttttcttcagtgtggactcgctgatgttgaataaggctgctctttcgactataagatttcccacactctccacaatcataaggtccttctgcagtgtgatctcgctgatgattactgaagctgacatatctgctaaaggattttccaccatcactgcacacataacatccatctctagtgaaaagtttctggtgtggaataactgagtgtttggtgctgaaggcttttgtgcgttttccacaactgtaattagtttttccctcctgaaagggtgggccatgcatagtttcactgtctgtcttctctacagcagcttcttcttggcacaatcctgaactgggcagaacgtccttcccaaactcgcggaagacaaatggctcctgtgacaccctgagcttacgtttctttacaaacgatgcttctctgacactctttctgtagaatttctctccaatatgctgcttctggtgctgatgaaggtatgcagtgtcatccagttttttccacatgctccagtgtggagaga

SEQ ID NO: 736650 - DNA, 1534 bp, Homo sapiens
ttttttttttacagaaaatttttagtaattttattcatttttcatagctttacagcttttatgaaaataatgatcactgtaagtataaaatgaaaattaaagaaaagggataataacccaaaactctccctggccaaaaaaccagttagcatatggcaaatatccttccacacattatcttcaggcatatattcacaatgaaaggtgatcatttatattaactagatcttaccaagagagccaccagccctatttctcccctaaatacgagttctattcctgttcatggttctgtgttatcatcttgatggatttgttagaaagattccaagtgtgaacaaacccccttccactctcagtagttttacagggtttaccaccagcatggactagccaaaaacttgaagatgtgcattcagacaaaagttggtaacacatttctcatttctaaagctttttaccagtatggactttctgatgatatgtaagacgtgaacggtgacggaagtccttatcacatatgtcacatttgtatggtttttctccagtgtggactctctgatgggcttcaagacgtgcactctgactgaagcctttaccacactcttcacatttaaagagtttttccctggtgtgaacacccaggtggactcgaagatttgaggggagactgaaggccttaccacactcctcacatatatggggtttctctcccgtgtggaccctctgatgatggcgaagattcaagctcctaccaaagcctttcccacactcttcacatttgtaaggtttttctccagtgtggcctctctgatggtatataaactgcgaactgtatctaaagccctttccacacacatcacatttgtatggcttttcccccgtgtggactctctgatgggattgaagaccagaggactgactgaagcccttaccacagacaccacatttgtatggcttctctccagtatggactctctgatgtacccgaaaatctatggcctgactgaagctcttatcacactgctcacatttatagggtttttctcctgagtgaactctttgatgtgcatgaagatttgatctccaactgaagcccttcccacattcctcacatttatatggtttttctccagtgtgaattacttggtgtagtttaagatttgaactataactgaagtccttaccacacacatcacatctatatggtttctctccagtgtggactcgctgatgggtttgaagctttgaggactgactgaagcccttcccacacgtttcacacttgaatcgtttctccccagtgtggacattctgatggacttgaagatttgaagcctgactgaagcccttaccacactccttacatttatagggtttctctcccgttgtggactctctgatggcactgaaaatttgaactttgactaaagcatttaccacattcctcgcatttatagggtttctctccagtatgaagtctacaaatgttaagggttaactgctgattgaaggtcttgccacactcggggca

SEQ ID NO: 736651 - DNA, 3095 bp, Homo sapiens
  misc_feature (2255)..(2255): n is a, c, g, or t
tgtagactgcttggttttatgtgttttaattaaatgtcatttccttgaattcattttaaggcttcttgcaagaatccttttcccagtacaattataatgacgaattggggctgagctcactaaaatattcaaatatatgtcctatatatgatagatttttcctatcaagttaaacaattccagggaagccactatttcttaggtacttgttcaaggtcacgatcatgcagcagtaaacaatgttcctgcatggagcttagattctagtggacacagattttgtcatgtccctcattatacttttgctaaattctgaccttacttatcattttgaaggcttcactcctgcatattgcttattggatgtgaaggttctgattgaaacatattgtatcattctttatagggtttctctgttgtgtgttctcttgacaactgtgacattttgggctctgcttgaaactggtcatattcatacaaaaataggttttcttcaatggaattcagataactataaaaactcagctcatgaattcttaaaacatgacattttataaatattctgtgctgtgtggattttctgaggaaaatgggaagtctaagtcttgaagagcacccctatcacactcatcatgattaatagattcatcaccatcatggactctctgatgaatctgaagacaacgaactcttactaaagcccttaccacacacaaaacatttgtatggtttctctccagtatggactctctgatgggcttgaagatgtgaagtctgactgaagctcttaccacacatgccacatttatagggtttctctcccgtgtggatcctctgatgaacatgaagatatgagttccagatgaagcctttcctacattcttcacatttgtatggtttctctcctgtgtggactctctgatgggcttgaagatgtgaactccaactgaagcctttcccacacacatcacatttgtagggattctctccagtatggacttgctgatggtcttggagatgcgaactctgactaaagcccttcccacatgtctcacatttgtatggcttctctcctttgtgaactctctgatgggcctgaagatgagagatctgactgaagtccttcccacatgtgtcacatttgtagggtttctctcctgtatggactctctgatgggcctgaaggtgggaattacggctgaagttcttatcacacacatcacatttgtagggtttctctccagtgtggattctctgatgggcttgaagatttgaggccttactgaagcccttatcacatacctcacatttatatggtttctctccagtgtgaactctctggtgaagaccagaattcctattaaatatcctgtcacttacttcccatttgtatgtcttgtctctagagtgacctctctgatgggcttgaagttgtgatgtctgactgaagcctttatcatatacatcacatttacaggctctctctccagcactgtctacacagtgaatgtcaaaatctaagctatgatggaagcccttcccacacctgccacatgtacacaacttctctcctgggtgagtaagctcatgagagggaagacaggagttctggttggagctccgggcatatacctgacatctgtagaggttctctcctgtgctgactctctgatgaggttgcagatgtgagccctgactgaagccctcaccactgtcaccattcctatagcatttctctcctatgtggaaacactgatgcctgggaagccctgagctgtaacctatgcccttcccgtactcaacatttacatgaggcttgtctcttaagtgtagttgctggtgaagttcaagattagagccaacacttaagccttttccattttcatcagaggtttgctctcctgattggattatgctatgctgggatgattccttcacacagtcttttccacaattattgtggctaaaagctttctctcttttgtgtactccatgatcatcatgttgatgagcaattctttgcctaacacaatgatcacatttacagagcttattttttacatcaatttgctgacacctactctgataattctgtggttctctcagatacattttcctccagaaatcccaggtggtcctcaatggaagctcttgattttttatgctatttgaactctccccttgtagctttattacatagttctcatcttcagagacctgactagattctcctgtccacacctgacagggggaancaccttgttttagcaacttggacctcttgccttgaagatttattattaggtcttgattactggttaatttacttgtaaattgttcccatatttgccagcatataaggtcttcatatgaaaggaatcttaatcttacttcttgaagggtatctatctcattttgattcttgtgtcatgatctggctatgtggagaatggactggagggaggtagaaggaggaaggtcatgtgcaagctgctgcagtaaaccagggcgatgaattctggggtcttgggccaggctggtggctgaggaggtggtgaggaggagaggactaggctgtaccccgcaaagactcagagctccatggttctcacctgaacacccatctccttggatttctgtctccatcatccgaagcttgtcttcttttcccaactgtaatatcacatctagtttgaagggttgatagcccactgacagcaggttcctgaagttctccagcatcacatcttggtacagctttctctgggcaaggtccagcaaccccagctcctccctggtgaagaccacagccacatccttgaatgtcaccatctcctgaaacttggtcattttctcctgctccttctggggaagggcagggtcctgggaaggcagaactcccagaggggatagatgacggctgcttcgccctcctgcagcggaagtacacaaggttgcaacggcttctgcactacacttcccagaatgcccgagcggaaacaggctaccgcccttatgaatctaggtgctcctgtattgggtgcatatatatttaggatagttagctcttcttgttgcattgatctctttaccat

SEQ ID NO: 736652 - DNA, 412 bp, Homo sapiens
aaagcagttttccagggagtcagagccactgacagcaggttcctgaagttctccagcatcacatcttggtacagctttctctgggcaaggtccagcaaccccagctcctccctggtgaagaccacagccacatccttgaatgtcaccatctcctgaaacttggtcattttctcctgctccttctggggaagggcagggtcctgggaaggcagaactcccagaggggatagatgacggctgcttcgccctcctgcagcggaagtacacaaggttgcaacggcttctgcactacacttcccagaatgcccgagcggaaacaggctaccgcccttatgaatctaggtgctcctgtattgggtgcatatatatttaggatagttagctcttcttgttgcattgatctctttaccat

SEQ ID NO: 736653 - DNA, 3182 bp, Homo sapiens; identical to SEQ ID NO: 262122

SEQ ID NO: 736654 - DNA, 2540 bp, Homo sapiens
ttccgctccaggaaggcgaggtcggatctgagatatctcccagggaggttcacttccccggaactctgccttttcccagaaggaggaggggaaaaatgaccaagttccaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcagggtttctctgttgtgtgttctcttgacaactgtgacattttgggctctgcttgaaactggtcatattcatacaaaaataggttttcttcaatggaattcagataactataaaaactcagctcatgaattcttaaaacatgacattttataaatattctgtgctgtgtggattttctgaggaaaatgggaagtctaagtcttgaagagcacccctatcacactcatcatgattaatagattcatcaccatcatggactctctgatgaatctgaagacaacgaactcttactaaagcccttaccacacacaaaacatttgtatggtttctctccagtatggactctctgatgggcttgaagatgtgaagtctgactgaagctcttaccacacatgccacatttatagggtttctctcccgtgtggatcctctgatgaacatgaagatatgagttccagatgaagcctttcctacattcttcacatttgtatggtttctctcctgtgtggactctctgatgggcttgaagatgtgaactccaactgaagcctttcccacacacatcacatttgtagggattctctccagtatggacttgctgatggtcttggagatgcgaactctgactaaagcccttcccacatgtctcacatttgtatggcttctctcctttgtgaactctctgatgggcctgaagatgagagatctgactgaagtccttcccacatgtgtcacatttgtagggtttctctcctgtatggactctctgatgggcctgaaggtgggaattacggctgaagttcttatcacacacatcacatttgtagggtttctctccagtgtggattctctgatgggcttgaagatttgaggccttactgaagcccttatcacatacctcacatttatatggtttctctccagtgtgaactctctggtgaagaccagaattcctattaaatatcctgtcacttacttcccatttgtatgtcttgtctctagagtgacctctctgatgggcttgaagttgtgatgtctgactgaagcctttatcatatacatcacatttacaggctctctctccagcactgtctacacagtgaatgtcaaaatctaagctatgatggaagcccttcccacacctgccacatgtacacaacttctctcctgggtgagtaagctcatgagagggaagacaggagttctggttggagctccgggcatatacctgacatctgtagaggttctctcctgtgctgactctctgatgaggttgcagatgtgagccctgactgaagccctcaccactgtcaccattcctatagcatttctctcctatgtggaaacactgatgcctgggaagccctgagctgtaacctatgcccttcccgtactcaacatttacatgaggcttgtctcttaagtgtagttgctggtgaagttcaagattagagccaacacttaagccttttccattttcatcagaggtttgctctcctgattggattatgctatgctgggatgattccttcacacagtcttttccacaattattgtggctaaaagctttctctcttttgtgtactccatgatcatcatgttgatgagcaattctttgcctgaacacccatctccttggatttctgtctccatcatccgaagcttgtcttcttttcccaactgtaatatcacatctagtttgaagggttgatagcccactgacagcaggttcctgaagttctccagcatcacatcttggtacagctttctctgggcaaggtccagcaaccccagctcctccctggtgaagaccacagccacatccttgaatgtcaccatctcctacaacatcaagcagatgtaatctcaatcttatggccaataactgaaacttggtcattttctcctgctccttctggggaagggcagggtcctgggaaggcagaactgcgagtccaacgcccaggccaggaaagctcgccgtagatgcagaggttccgcgctgactcacctcccagaggggatagatgacggctgcttcgccctcctgcagcggaagtacacaaggttgcaacggcttctgcactacacttcccagaatgcccgagcggaaacaggctaccgcccttatgaatctaggtgctcctgtattgggtgcatatatatttaggatagttagctcttcttgttgcattgatctctttaccat

SEQ ID NO: 736655 - DNA, 2613 bp, Homo sapiens
tgtagactgcttggttttatgtgttttaattaaatgtcatttccttgaattcattttaaggcttcttgcaagaatccttttcccagtacaattataatgacgaattggggctgagctcactaaaatattcaaatatatgtcctatatatgatagatttttcctatcaagttaaacaattccagggaagccactatttcttaggtacttgttcaaggtcacgatcatgcagcagtaaacaatgttcctgcatggagcttagattctagtggacacagattttgtcatgtccctcattatacttttgctaaattctgaccttacttatcattttgaaggcttcactcctgcatattgcttattggatgtgaaggttctgattgaaacatattgtatcattctttatagggtttctctgttgtgtgttctcttgacaactgtgacattttgggctctgcttgaaactggtcatattcatacaaaaataggttttcttcaatggaattcagataactataaaaactcagctcatgaattcttaaaacatgacattttataaatattctgtgctgtgtggattttctgaggaaaatgggaagtctaagtcttgaagagcacccctatcacactcatcatgattaatagattcatcaccatcatggactctctgatgaatctgaagacaacgaactcttactaaagcccttaccacacacaaaacatttgtatggtttctctccagtatggactctctgatgggcttgaagatgtgaagtctgactgaagctcttaccacacatgccacatttatagggtttctctcccgtgtggatcctctgatgaacatgaagatatgagttccagatgaagcctttcctacattcttcacatttgtatggtttctctcctgtgtggactctctgatgggcttgaagatgtgaactccaactgaagcctttcccacacacatcacatttgtagggattctctccagtatggacttgctgatggtcttggagatgcgaactctgactaaagcccttcccacatgtctcacatttgtatggcttctctcctttgtgaactctctgatgggcctgaagatgagagatctgactgaagtccttcccacatgtgtcacatttgtagggtttctctcctgtatggactctctgatgggcctgaaggtgggaattacggctgaagttcttatcacacacatcacatttgtagggtttctctccagtgtggattctctgatgggcttgaagatttgaggccttactgaagcccttatcacatacctcacatttatatggtttctctccagtgtgaactctctggtgaagaccagaattcctattaaatatcctgtcacttacttcccatttgtatgtcttgtctctagagtgacctctctgatgggcttgaagttgtgatgtctgactgaagcctttatcatatacatcacatttacaggctctctctccagcactgtctacacagtgaatgtcaaaatctaagctatgatggaagcccttcccacacctgccacatgtacacaacttctctcctgggtgagtaagctcatgagagggaagacaggagttctggttggagctccgggcatatacctgacatctgtagaggttctctcctgtgctgactctctgatgaggttgcagatgtgagccctgactgaagccctcaccactgtcaccattcctatagcatttctctcctatgtggaaacactgatgcctgggaagccctgagctgtaacctatgcccttcccgtactcaacatttacatgaggcttgtctcttaagtgtagttgctggtgaagttcaagattagagccaacacttaagccttttccattttcatcagaggtttgctctcctgattggattatgctatgctgggatgattccttcacacagtcttttccacaattattgtggctaaaagctttctctcttttgtgtactccatgatcatcatgttgatgagcaattctttgcctgaacacccatctccttggatttctgtctccatcatccgaagcttgtcttcttttcccaactgtaatatcacatctagtttgaagggttgatagcccactgacagcaggttcctgaagttctccagcatcacatcttggtacagctttctctgggcaaggtccagcaaccccagctcctccctggtgaagaccacagccacatccttgaatgtcaccatctcctacaacatcaagcagatgtaatctcaatcttatggccaataactgaaacttggtcattttctcctgctccttctggggaagggcagggtcctgggaaggcagaactgcgagtccaacgcccaggccaggaaagctcgccgtagatgcagaggttccgcgctgactcacctcccagaggggatagatgacggctgcttcgccctcctgcagcggaagtacacaaggttgcaacggcttctgcactacacttcccagaatgcccgagcggaaacaggctaccgcccttatgaatctaggtgctcctgtattgggtgcatatatatttaggatagttagctcttcttgttgcattgatctctttaccat

SEQ ID NO: 736656 - DNA, 3040 bp, Homo sapiens
ttttttttttacagaaaatttttagtaattttattcatttttcatagctttacagcttttatgaaaataatgatcactgtaagtataaaatgaaaattaaagaaaagggataataacccaaaactctccctggccaaaaaaccagttagcatatggcaaatatccttccacacattatcttcaggcatatattcacaatgaaaggtgatcatttatattaactagatcttaccaagagagccaccagccctatttctcccctaaatacgagttctattcctgttcatggttctgtgttatcatcttgatggatttgttagaaagattccaagtgtgaacaaacccccttccactctcagtagttttacagggtttaccaccagcatggactagccaaaaacttgaagatgtgcattcagacaaaagttggtaacacatttctcatttctaaagctttttaccagtatggactttctgatgatatgtaagacgtgaacggtgacggaagtccttatcacatatgtcacatttgtatggtttttctccagtgtggactctctgatgggcttcaagacgtgcactctgactgaagcctttaccacactcttcacatttaaagagtttttccctggtgtgaacacccaggtggactcgaagatttgaggggagactgaaggccttaccacactcctcacatatatggggtttctctcccgtgtggaccctctgatgatggcgaagattcaagctcctaccaaagcctttcccacactcttcacatttgtaaggtttttctccagtgtggcctctctgatggtatataaactgcgaactgtatctaaagccctttccacacacatcacatttgtatggcttttcccccgtgtggactctctgatgggattgaagaccagaggactgactgaagcccttaccacagacaccacatttgtatggcttctctccagtatggactctctgatgtacccgaaaatctatggcctgactgaagctcttatcacactgctcacatttatagggtttttctcctgagtgaactctttgatgtgcatgaagatttgatctccaactgaagcccttcccacattcctcacatttatatggtttttctccagtgtgaattacttggtgtagtttaagatttgaactataactgaagtccttaccacacacatcacatctatatggtttctctccagtgtggactcgctgatgggtttgaagctttgaggactgactgaagcccttcccacacgtttcacacttgaatcgtttctccccagtgtggacattctgatggacttgaagatttgaagcctgactgaagcccttaccacactccttacatttatagggtttctctcccgtgtgaactctgaaatgaatatgcagatctgtattacgggtaaagcctttcccacacgcctcacacttgtatggcttctctcctgtgtggactctccgatggcatattaatggtgaattgtggctgaagcccttaccacacacatcacacttgtagggtttctctccagtgtggactctctgatggatgtgaaaatgtgcagcctgagtgaagcccttaccacattcctcacatttatagggcttctcacccctgtggaccctctggtgaacacggagattaacactccaaccgaagcccttaccacactcttcgcatttgtatggtttttcttcagtgtggactctctgatggcactgaaaatttgaactttgactaaagcatttaccacattcctcgcatttatagggtttctctccagtatgagttctgtaatgaatgataagacccgtgctgctactgaatcccttgccgcaactgtcgcatctataagacttctctcctgtatgattagattgataagaatgaaaagagctcttattgaagcaatcaccagattcatgacatctattgagtttctctcctgggtgaattctctgatgagttcgcagatgtgagctttgactgaagcatttttctcctgtatgaacattcggatgaaggggaagccttgggctataactgaagccccttccacactcaccacatggatggggtttctctcctaagggtaatttctgattggagccatcactaatgattttgccatattcattacctttgcagggttttggttctgtgtcagttttaatatgctcatgaaatggtgatttcttcatgaagtcttcatgtatttgcaggttatttttcacatcaatttgcttacctctactctgaatctgtgactcactcagatatgtattcccgcaagaatgctgggttctccaaaatggaaactcttgattttcaatataaatagagctatctcctttagggttcattatattgttctcattttcagaaacctgaatagagtcaccttgtaataactgggaactcttcccctgaagacacctggttaattcacttgcaacctgtttccagatttgccagcaggacagctcttgatttgaaaggtattttaatgcaaatttttggagtgtttccatcttattttgatgcttgctgcccactgcaaccaggttcttgaagttctccaccatgacatctcggtacagcttcctctgggtaagatcgagcagtcgcagttcctccctggagaagaccacagccacatccttgaatgtcacagcctcctacaatatcaaacacatgtaacctcaatcttacaaccaaccttcactagaagaagggtggcatcaagaaggaaaagagcaccacaaaaaagttgttatagattccaagagatctcagtcaattttcagctgttacagttttccctgtctcactatctcctacgctcatccccataaagcctgtagtttatcactgttttttgtttttttcttttttgagatggagtctcactctgtcacccgacctggagcagtggcgcaatctctgctcactgcaacctccgcctcccgggttcaagagattctcctgccttagcctcccaagtaggtgggatta

SEQ ID NO: 736657 - DNA, 3249 bp, Homo sapiens
ttttttttttacagaaaatttttagtaattttattcatttttcatagctttacagcttttatgaaaataatgatcactgtaagtataaaatgaaaattaaagaaaagggataataacccaaaactctccctggccaaaaaaccagttagcatatggcaaatatccttccacacattatcttcaggcatatattcacaatgaaaggtgatcatttatattaactagatcttaccaagagagccaccagccctatttctcccctaaatacgagttctattcctgttcatggttctgtgttatcatcttgatggatttgttagaaagattccaagtgtgaacaaacccccttccactctcagtagttttacagggtttaccaccagcatggactagccaaaaacttgaagatgtgcattcagacaaaagttggtaacacatttctcatttctaaagctttttaccagtatggactttctgatgatatgtaagacgtgaacggtgacggaagtccttatcacatatgtcacatttgtatggtttttctccagtgtggactctctgatgggcttcaagacgtgcactctgactgaagcctttaccacactcttcacatttaaagagtttttccctggtgtgaacacccaggtggactcgaagatttgaggggagactgaaggccttaccacactcctcacatatatggggtttctctcccgtgtggaccctctgatgatggcgaagattcaagctcctaccaaagcctttcccacactcttcacatttgtaaggtttttctccagtgtggcctctctgatggtatataaactgcgaactgtatctaaagccctttccacacacatcacatttgtatggcttttcccccgtgtggactctctgatgggattgaagaccagaggactgactgaagcccttaccacagacaccacatttgtatggcttctctccagtatggactctctgatgtacccgaaaatctatggcctgactgaagctcttatcacactgctcacatttatagggtttttctcctgagtgaactctttgatgtgcatgaagatttgatctccaactgaagcccttcccacattcctcacatttatatggtttttctccagtgtgaattacttggtgtagtttaagatttgaactataactgaagtccttaccacacacatcacatctatatggtttctctccagtgtggactcgctgatgggtttgaagctttgaggactgactgaagcccttcccacacgtttcacacttgaatcgtttctccccagtgtggacattctgatggacttgaagatttgaagcctgactgaagcccttaccacactccttacatttatagggtttctctcccgtgtgaactctgaaatgaatatgcagatctgtattacgggtaaagcctttcccacacgcctcacacttgtatggcttctctcctgtgtggactctccgatggcatattaatggtgaattgtggctgaagcccttaccacacacatcacacttgtagggtttctctccagtgtggactctctgatggatgtgaaaatgtgcagcctgagtgaagcccttaccacattcctcacatttatagggcttctcacccctgtggaccctctggtgaacacggagattaacactccaaccgaagcccttaccacactcttcgcatttgtatggtttttcttcagtgtggactctctgatggcactgaaaatttgaactttgactaaagcatttaccacattcctcgcatttatagggtttctctccagtatgagttctgtaatgaatgataagacccgtgctgctactgaatcccttgccgcaactgtcgcatctataagacttctctcctgtatgattagattgataagaatgaaaagagctcttattgaagcaatcaccagattcatgacatctattgagtttctctcctgggtgaattctctgatgagttcgcagatgtgagctttgactgaagcatttttctcctgtatgaacattcggatgaaggggaagccttgggctataactgaagccccttccacactcaccacatggatggggtttctctcctaagggtaatttctgattggagccatcactaatgattttgccatattcattacctttgcagggttttggttctgtgtcagttttaatatgctcatgaaatggtgatttcttcatgaagtcttcatgtatttgcaggttatttttcacatcaatttgcttacctctactctgaatctgtgactcactcagatatgtattcccgcaagaatgctgggttctccaaaatggaaactcttgattttcaatataaatagagctatctcctttagggttcattatattgttctcattttcagaaacctgaatagagtcaccttgtaataactgggaactcttcccctgaagacacctggttaattcacttgcaacctgtttccagatttgccagcaggacagctcttgatttgaaaggtattttaatgcaaatttttggagtgtttccatcttattttgatgcttgctgcccactgcaaccaggttcttgaagttctccaccatgacatctcggtacagcttcctctgggtaagatcgagcagtcgcagttcctccctggagaagaccacagccacatccttgaatgtcacagcctcctacaatatcaaacacatgtaacctcaatcttacaaccaaccttcactagaagaagggtggcatcaagaaggaaaagagcaccacaaaaaagttgttatagattccaagagatctcagtcaattttcagctgttacagttttccctgtctcactatctcctacgctcatccccataaagcctgtagtttatcactgttttttgtttttttcttttttgagatggagtctcactctgtcacccgacctgggaagcggaggttgcagtgagccaagatggcgccactgcactccagcctgggtgacaggggtgagacactgtcttaaaataaataaatttttagaattaaaataaatagatcataaagtgtttgaaaggatcagatgaatgaatatatgtcaagcacttagaagtgcctagcacaccatacatgctcaataaactcgaacaacgcatatctttatcatctcttttgtcctattttgtgactacatacaacaggattccttggaactgaagatttatctctaaccaatccaaataatgt

SEQ ID NO: 736658 - DNA, 3325 bp, Homo sapiens
ttttttttttacagaaaatttttagtaattttattcatttttcatagctttacagcttttatgaaaataatgatcactgtaagtataaaatgaaaattaaagaaaagggataataacccaaaactctccctggccaaaaaaccagttagcatatggcaaatatccttccacacattatcttcaggcatatattcacaatgaaaggtgatcatttatattaactagatcttaccaagagagccaccagccctatttctcccctaaatacgagttctattcctgttcatggttctgtgttatcatcttgatggatttgttagaaagattccaagtgtgaacaaacccccttccactctcagtagttttacagggtttaccaccagcatggactagccaaaaacttgaagatgtgcattcagacaaaagttggtaacacatttctcatttctaaagctttttaccagtatggactttctgatgatatgtaagacgtgaacggtgacggaagtccttatcacatatgtcacatttgtatggtttttctccagtgtggactctctgatgggcttcaagacgtgcactctgactgaagcctttaccacactcttcacatttaaagagtttttccctggtgtgaacacccaggtggactcgaagatttgaggggagactgaaggccttaccacactcctcacatatatggggtttctctcccgtgtggaccctctgatgatggcgaagattcaagctcctaccaaagcctttcccacactcttcacatttgtaaggtttttctccagtgtggcctctctgatggtatataaactgcgaactgtatctaaagccctttccacacacatcacatttgtatggcttttcccccgtgtggactctctgatgggattgaagaccagaggactgactgaagcccttaccacagacaccacatttgtatggcttctctccagtatggactctctgatgtacccgaaaatctatggcctgactgaagctcttatcacactgctcacatttatagggtttttctcctgagtgaactctttgatgtgcatgaagatttgatctccaactgaagcccttcccacattcctcacatttatatggtttttctccagtgtgaattacttggtgtagtttaagatttgaactataactgaagtccttaccacacacatcacatctatatggtttctctccagtgtggactcgctgatgggtttgaagctttgaggactgactgaagcccttcccacacgtttcacacttgaatcgtttctccccagtgtggacattctgatggacttgaagatttgaagcctgactgaagcccttaccacactccttacatttatagggtttctctcccgtgtgaactctgaaatgaatatgcagatctgtattacgggtaaagcctttcccacacgcctcacacttgtatggcttctctcctgtgtggactctccgatggcatattaatggtgaattgtggctgaagcccttaccacacacatcacacttgtagggtttctctccagtgtggactctctgatggatgtgaaaatgtgcagcctgagtgaagcccttaccacattcctcacatttatagggcttctcacccctgtggaccctctggtgaacacggagattaacactccaaccgaagcccttaccacactcttcgcatttgtatggtttttcttcagtgtggactctctgatggcactgaaaatttgaactttgactaaagcatttaccacattcctcgcatttatagggtttctctccagtatgagttctgtaatgaatgataagacccgtgctgctactgaatcccttgccgcaactgtcgcatctataagacttctctcctgtatgattagattgataagaatgaaaagagctcttattgaagcaatcaccagattcatgacatctattgagtttctctcctgggtgaattctctgatgagttcgcagatgtgagctttgactgaagcatttttctcctgtatgaacattcggatgaaggggaagccttgggctataactgaagccccttccacactcaccacatggatggggtttctctcctaagggtaatttctgattggagccatcactaatgattttgccatattcattacctttgcagggttttggttctgtgtcagttttaatatgctcatgaaatggtgatttcttcatgaagtcttcatgtatttgcaggttatttttcacatcaatttgcttacctctactctgaatctgtgactcactcagatatgtattcccgcaagaatgctgggttctccaaaatggaaactcttgattttcaatataaatagagctatctcctttagggttcattatattgttctcattttcagaaacctgaatagagtcaccttgtaataactgggaactcttcccctgaagacacctggttaattcacttgcaacctgtttccagatttgccagcaggacagctcttgatttgaaaggtattttaatgcaaatttttggagtgtttccatcttattttgatgcttgctgcccactgcaaccaggttcttgaagttctccaccatgacatctcggtacagcttcctctgggtaagatcgagcagtcgcagttcctccctggagaagaccacagccacatccttgaatgtcacagcctcctgaaacttggtcattttctcctgcttcttctggggaaggtcatagttctgagatggcataactggggctatgctgggagaagccaagaagtccctccttcctcctctttgcaaattcggaggcggtgaataaaaggatgctgtcagcacgatggagtctctatcccggataaacggcggtaaacatccccacgcattggagcccgatgactcaatccttcttaaaaaaaaaaaagatctgtaaaagttcgggaagagctcggtctcctgaaggatacgacagaaaggccatggcataaagccctgacttttcttctctcttcactggagcttccagtaaaaagggcgcttgtgagggaatcactgtatcaatagcaggagccaacccagtatcaggtgccaccactgttctaaggtttgacccgtattatcttgtttaattctaattacaaccctacacagtaacgactatctttattgctattttaaagatgaggaaacaggagcgcggatcataggtaactcgctgtttattatacccacagaactagcggcgctgcttgccaagtgcgggaggagagcaaacttcccgccctcggcctctcggcctccgccgcggccg

SEQ ID NO: 736659 - DNA, 3057 bp, Homo sapiens
ttttttttttacagaaaatttttagtaattttattcatttttcatagctttacagcttttatgaaaataatgatcactgtaagtataaaatgaaaattaaagaaaagggataataacccaaaactctccctggccaaaaaaccagttagcatatggcaaatatccttccacacattatcttcaggcatatattcacaatgaaaggtgatcatttatattaactagatcttaccaagagagccaccagccctatttctcccctaaatacgagttctattcctgttcatggttctgtgttatcatcttgatggatttgttagaaagattccaagtgtgaacaaacccccttccactctcagtagttttacagggtttaccaccagcatggactagccaaaaacttgaagatgtgcattcagacaaaagttggtaacacatttctcatttctaaagctttttaccagtatggactttctgatgatatgtaagacgtgaacggtgacggaagtccttatcacatatgtcacatttgtatggtttttctccagtgtggactctctgatgggcttcaagacgtgcactctgactgaagcctttaccacactcttcacatttaaagagtttttccctggtgtgaacacccaggtggactcgaagatttgaggggagactgaaggccttaccacactcctcacatatatggggtttctctcccgtgtggaccctctgatgatggcgaagattcaagctcctaccaaagcctttcccacactcttcacatttgtaaggtttttctccagtgtggcctctctgatggtatataaactgcgaactgtatctaaagccctttccacacacatcacatttgtatggcttttcccccgtgtggactctctgatgggattgaagaccagaggactgactgaagcccttaccacagacaccacatttgtatggcttctctccagtatggactctctgatgtacccgaaaatctatggcctgactgaagctcttatcacactgctcacatttatagggtttttctcctgagtgaactctttgatgtgcatgaagatttgatctccaactgaagcccttcccacattcctcacatttatatggtttttctccagtgtgaattacttggtgtagtttaagatttgaactataactgaagtccttaccacacacatcacatctatatggtttctctccagtgtggactcgctgatgggtttgaagctttgaggactgactgaagcccttcccacacgtttcacacttgaatcgtttctccccagtgtggacattctgatggacttgaagatttgaagcctgactgaagcccttaccacactccttacatttatagggtttctctcccgtgtgaactctgaaatgaatatgcagatctgtattacgggtaaagcctttcccacacgcctcacacttgtatggcttctctcctgtgtggactctccgatggcatattaatggtgaattgtggctgaagcccttaccacacacatcacacttgtagggtttctctccagtgtggactctctgatggatgtgaaaatgtgcagcctgagtgaagcccttaccacattcctcacatttatagggcttctcacccctgtggaccctctggtgaacacggagattaacactccaaccgaagcccttaccacactcttcgcatttgtatggtttttcttcagtgtggactctctgatggcactgaaaatttgaactttgactaaagcatttaccacattcctcgcatttatagggtttctctccagtatgagttctgtaatgaatgataagacccgtgctgctactgaatcccttgccgcaactgtcgcatctataagacttctctcctgtatgattagattgataagaatgaaaagagctcttattgaagcaatcaccagattcatgacatctattgagtttctctcctgggtgaattctctgatgagttcgcagatgtgagctttgactgaagcatttttctcctgtatgaacattcggatgaaggggaagccttgggctataactgaagccccttccacactcaccacatggatggggtttctctcctaagggtaatttctgattggagccatcactaatgattttgccatattcattacctttgcagggttttggttctgtgtcagttttaatatgctcatgaaatggtgatttcttcatgaagtcttcatgtatttgcaggttatttttcacatcaatttgcttacctctactctgaatctgtgactcactcagatatgtattcccgcaagaatgctgggttctccaaaatggaaactcttgattttcaatataaatagagctatctcctttagggttcattatattgttctcattttcagaaacctgaatagagtcaccttgtaataactgggaactcttcccctgaagacacctggttaattcacttgcaacctgtttccagatttgccagcaggacagctcttgatttgaaaggtattttaatgcaaatttttggagtgtttccatcttattttgatgcttgctgcttctttgggtttctgtttccatcatccaaagcttttcttctgcttccaattgggataccatatctggttggaagggaagatgccccactgcaaccaggttcttgaagttctccaccatgacatctcggtacagcttcctctgggtaagatcgagcagtcgcagttcctccctggagaagaccacagccacatccttgaatgtcacagcctcctgaaacttggtcattttctcctgcttcttctggggaaggtcatagttctgagatggcataactggggctatgctgggagaagccaagaagtccctccttcctcctctttgcaaattcggaggcggtgaataaaaggatgctgtcagcacgatggagtctctatcccggataaacggcggtaaacatccccacgcattggagcccgatgactcaatcctcccggacccaaaagatggtggcggcctcgctttccggggcggaagtcggct

SEQ ID NO: 736660 - DNA, 3135 bp, Homo sapiens
ttttttttttacagaaaatttttagtaattttattcatttttcatagctttacagcttttatgaaaataatgatcactgtaagtataaaatgaaaattaaagaaaagggataataacccaaaactctccctggccaaaaaaccagttagcatatggcaaatatccttccacacattatcttcaggcatatattcacaatgaaaggtgatcatttatattaactagatcttaccaagagagccaccagccctatttctcccctaaatacgagttctattcctgttcatggttctgtgttatcatcttgatggatttgttagaaagattccaagtgtgaacaaacccccttccactctcagtagttttacagggtttaccaccagcatggactagccaaaaacttgaagatgtgcattcagacaaaagttggtaacacatttctcatttctaaagctttttaccagtatggactttctgatgatatgtaagacgtgaacggtgacggaagtccttatcacatatgtcacatttgtatggtttttctccagtgtggactctctgatgggcttcaagacgtgcactctgactgaagcctttaccacactcttcacatttaaagagtttttccctggtgtgaacacccaggtggactcgaagatttgaggggagactgaaggccttaccacactcctcacatatatggggtttctctcccgtgtggaccctctgatgatggcgaagattcaagctcctaccaaagcctttcccacactcttcacatttgtaaggtttttctccagtgtggcctctctgatggtatataaactgcgaactgtatctaaagccctttccacacacatcacatttgtatggcttttcccccgtgtggactctctgatgggattgaagaccagaggactgactgaagcccttaccacagacaccacatttgtatggcttctctccagtatggactctctgatgtacccgaaaatctatggcctgactgaagctcttatcacactgctcacatttatagggtttttctcctgagtgaactctttgatgtgcatgaagatttgatctccaactgaagcccttcccacattcctcacatttatatggtttttctccagtgtgaattacttggtgtagtttaagatttgaactataactgaagtccttaccacacacatcacatctatatggtttctctccagtgtggactcgctgatgggtttgaagctttgaggactgactgaagcccttcccacacgtttcacacttgaatcgtttctccccagtgtggacattctgatggacttgaagatttgaagcctgactgaagcccttaccacactccttacatttatagggtttctctcccgttgtggactctctgatggcactgaaaatttgaactttgactaaagcatttaccacattcctcgcatttatagggtttctctccagtatgagttctgtaatgaatgataagacccgtgctgctactgaatcccttgccgcaactgtcgcatctataagacttctctcctgtatgattagattgataagaatgaaaagagctcttattgaagcaatcaccagattcatgacatctattgagtttctctcctgggtgaattctctgatgagttcgcagatgtgagctttgactgaagcatttttctcctgtatgaacattcggatgaaggggaagccttgggctataactgaagccccttccacactcaccacatggatggggtttctctcctaagggtaatttctgattggagccatcactaatgattttgccatattcattacctttgcagggttttggttctgtgtcagttttaatatgctcatgaaatggtgatttcttcatgaagtcttcatgtatttgcaggttatttttcacatcaatttgcttacctctactctgaatctgtgactcactcagatatgtattcccgcaagaatgctgggttctccaaaatggaaactcttgattttcaatataaatagagctatctcctttagggttcattatattgttctcattttcagaaacctgaatagagtcaccttgtaataactgggaactcttcccctgaagacacctggttaattcacttgcaacctgtttccagatttgccagcaggacagctcttgatttgaaaggtattttaatgcaaatttttggagtgtttccatcttattttgatgcttgctgcttctttgggtttctgtttccatcatccaaagcttttcttctgcttccaattgggataccatatctggttggaagggaagatgccctgagagcaaagagattctcaagggaactgaagttcagggtcagagagtgcctgtcctcacccactgcaaccaggttcttgaagttctccaccatgacatctcggtacagcttcctctgggtaagatcgagcagtcgcagttcctccctggagaagaccacagccacatccttgaatgtcacagcctcctgaaacttggtcattttctcctgcttcttctggggaaggtcatagttctgagatggcataactggggctatgctgggagaagccaagaagtccctccttcctcctctttgcaaattcggaggcggtgaataaaaggatgctgtcagcacgatggagtctctatcccggataaacggcggtaaacatccccacgcattggagcccgatgactcaatccttcttaaaaaaaaaaaagatctgtaaaagttcgggaagagctcggtctcctgaaggatacgacagaaaggccatggcataaagccctgacttttcttctctcttcactggagcttccagtaaaaagggcgcttgtgagggaatcactgtatcaatagcaggagccaacccagtatcaggtgccaccactgttctaaggtttgacccgtattatcttgtttaattctaattacaaccctacacagtaacgactatctttattgctattttaaagatgaggaaacaggagcgcggatcataggtaactcgctgtttattatacccacagaactagcggcgctgcttgccaagtgcgggaggagagcaaacttcccgccctcggcctctcggcctccgccgcggccg

SEQ ID NO: 736661 - DNA, 1088 bp, Homo sapiens
taccccgtatctgcgcatccacatcaatttgcttacctctactctgaatctgtgactcactcagatatgtattcccgcaagaatgctgggttctccaaaatggaaactcttgattttcaatataaatagagctatctcctttagggttcattatattgttctcattttcagaaacctgaatagagtcaccttgtaataactgggaactcttcccctgaagacacctggttaattcacttgcaacctgtttccagatttgccagcaggacagctcttgatttgaaaggtattttaatgcaaatttttggagtgtttccatcttattttgatgcttgctgcccactgcaaccaggttcttgaagttctccaccatgacatctcggtacagcttcctctgggtaagatcgagcagtcgcagttcctccctggagaagaccacagccacatccttgaatgtcacagcctcctgaaacttggtcattttctcctgcttcttctggggaaggtcatagttctgagatggcataactggggctatgctgggagaagccaagaagtccctccttcctcctctttgcaaattcggaggcggtgaataaaaggatgctgtcagcacgatggagtctctatcccggataaacggcggtaaacatccccacgcattggagcccgatgactcaatccttcttaaaaaaaaaaaagatctgtaaaagttcgggaagagctcggtctcctgaaggatacgacagaaaggccatggcataaagccctgacttttcttctctcttcactggagcttccagtaaaaagggcgcttgtgagggaatcactgtatcaatagcaggagccaacccagtatcaggtgccaccactgttctaaggtttgacccgtattatcttgtttaattctaattacaaccctacacagtaacgactatctttattgctattttaaagatgaggaaacaggagcgcggatcataggtaactcgctgtttattatacccacagaactagcggcgctgcttgccaagtgcgggaggagagcaaacttcccgccctcggcctctcggcctccgccgcggccg

SEQ ID NO: 736662 - DNA, 2175 bp, Homo sapiens
cttagggctggtgctcctgctatttcctcttcccaggtaaccatgtgaagtgcctccctctgccctctttccagcctttacttgagtgtcaccttctcagtgaggcctgccctcattcctctttcgctgtttgcaacccatctcctgtcccccttcccagaactccctttcctacttcgtttttcttcacagtacttgatactgcctaacacactccatggtttcttacttgccctgtttattattttcccccaatagacagaatgttccatgatggcagaattctctgttttgtttccttccatgtccccagcacctagaacagtgcctgacgcatctcctaagcaatacgaccaataagtatgtgtctggctgccttccggctgccagtgtctgcctctttcctaggggcagtggttgcgggggtgctttctcacatgtcttagtaggctgtgcaggctggaagtgctcagaagtcacacccccagggagcagcctcagccaacagcaccttggctgtaaatgccccagctccctcgccctcaggtaagcattgctgaggcacacgttccatactcttttccacagttcctccgtgggactgagcaccacccagccacccacaggagcagctaacctgataaccaccagcctcaccctccctgccttacttccccgctcccctttaccacatgctgacctcccagatgcatttcttgctttccggtctctgtctcaggattggctcctggatgaacacaaactaacactatgttcacaaatatatttgggaaatgctggatgaataattatacacatcagacagattactagaaattctcaccaaagggatgcacatgttacctctgcatggtgagatctcaggtgctttttaccccacatagctatcctttggcatttttataattagcaagtgctcactcttccactgtcagtacattctcattcttcttgggcgctggacaagaattcaaccggtgtgtaagccagactcggcccgggcagtctcaaactcctgactccttatataatttctacaaaaattataaagctatttcccactccccaccccacattcatgtaacctgaagcatgagtaaaccaagaatgaggtaggcctctgtcttctaagcaacatcagaactctaagaacatgagggactcttagaaaactctctggagctaaccacagctgggtcactgctcatgtactgaagaccagccagagggttcccctgaaaaggagggaaactgagcaaacattctccagttctcttagtgtgcacatgtttcaggaggtgtgaaccccacatgtagcttgtgtaggcaagaagacaaatagtgctactgtctggtcaaggatttgtttgaagagccatgattatgcccatatggtaagccaccagtgctccccatccctgtaagacacttctttctcattattttctcctctgatggtgtgccaggatgctggccaagagaagccaagtggaaagaaggctgttcagtgacaaggaacctaagacttagtgccaaggactgaaaccaagtaaacttgtaattttccatgatggaaacatctacactttctcattagtggcctctacagcagttgccccaaagaagcgtctcattgtttttttactacatttatgtgaagcatacaggcaaactcagaaagactgtgataaggctcgccagagatgcctgcacaggtgctgggggaaaagcaggaccatcctgaagggagatggtgtctgtggacaaagaactctgcagtggttcttatttgcatgatttctgctggtggaggctgtaaatgtgagctcaaactcccacataagtgagttttcattgtaatccagaatgtttttaaatcaccctacttctattgaacttgcactatcatctgttaacctctactgtatttattaaataaacctgaataggtaaatcacagtacagcaaaaggttctgtgttccccagaattctaatcaaactccaaattcctgaaaaggctctagtcctttcctatatgtcaaatttaaatgataagttttcattttggaacataaagagggattttgaagaccacagcatagccctgggtttttgcatagagataataaacagacaatctcttttcagactga

SEQ ID NO: 736663 - DNA, 1072 bp, Homo sapiens
  misc_feature (814)..(814): n is a, c, g, or t
ggtccggaattccctgcatacaggcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaganaacaaatcccgggcggggggtcccgctataaatggtggggcttgaacaaagtttcccacagagcctccccgaaaaaaccaaggggggggccctgaaaaaactccccaaaaaacaggaaccctgggtccccctggcctcttcccggaacactctgaagaaaaaaaaatgggtgaaggcccccaagggggaagggggggccccagagcctcctccctccagaggtgccaaaagaaagtcctctgcgagaaaaaaccctct

SEQ ID NO: 736664 - DNA, 2201 bp, Homo sapiens
gaattccggttctcactcttgacgttgtccagctccagcaccttggcaactcccccagcttggacggccggcccgccgctccatgggggagtcatctgaggcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcatccttaaaagccatggagccggaggtggcaattcaccgaattc

SEQ ID NO: 736665 - DNA, 1256 bp, Homo sapiens
  misc_feature (68)..(68): n is a, c, g, or t
  misc_feature (1184)..(1184): n is a, c, g, or t
ttatcttcactcccacgcgctcggagggggggcgtgagggggcggagacactgtggggggaggggggnggggaaaatacaacaaatggggcgacccacgcgtccgcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggaacctgggggtcccaatgccaaccaactggtcaagtcttgcctggncccccaaaacataaggggggtccccctccccccacctgggggcaaaaaaaacccccatggagaccctctttg

SEQ ID NO: 736666 - DNA, 1145 bp, Homo sapiens
  misc_feature (1116)..(1116): n is a, c, g, or t
gtgagttttgcttcctggccctctgctctcccgtccttctggtggttcctgcccatgaaagagaatcccagagctcagcaaggcctctgctgccctcccactgttcctctcctctccctaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccatctcctgccaaaaaaaaatanggggccccatcccggggaaaaaaaggccc

SEQ ID NO: 736667 - DNA, 535 bp, Homo sapiens
  misc_feature (16)..(16): n is a, c, g, or t
  misc_feature (23)..(23): n is a, c, g, or t
  misc_feature (25)..(26): n is a, c, g, or t
  misc_feature (37)..(37): n is a, c, g, or t
  misc_feature (44)..(44): n is a, c, g, or t
  misc_feature (49)..(50): n is a, c, g, or t
  misc_feature (63)..(63): n is a, c, g, or t
  misc_feature (74)..(74): n is a, c, g, or t
gctgactgagctgtcntgtcagntnntgtatataccntcctcgntgcannatccaacgtcttnaagatccgcgnggcaaagtacgggccggcgttttacaatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccagtctgtccggacagacgccacgtccaccgactgaccggcattgcgcccggtaccagcgttcgataggtcgccggtacggatggcggatggcgcagaaccggcgatcccattcatcgccggcgcaacagattcggcatccagccgatgccttgtgcatgcaggctctggatgtataaccgctccggcgtatcggtcacgccggtggtttccggatatttgccgccgggtcctgcggtcccgtgtata

SEQ ID NO: 736668 - DNA, 527 bp, Homo sapiens; identical to SEQ ID NO: 323249

SEQ ID NO: 736669 - DNA, 1024 bp, Homo sapiens
ggtcctctggccttagtcatcagcttggaggagggggcaccaccccagagccacaacatctgcgcttttctctggagaagatcttgttacaggacccattatacccctatgtcccgaaagaatactctggggatccccccaggagtgctgctggcctttggggtagagggtccatgaggtgctctgggtggtgtcctgtagtgcagttcagattcatagatgtcggccgagtatttggggggttaagagcaggtgccttggaaccagactgcctgggtccaaattgtggctccttcagttaatagacgtgtgactaggagtagcttgttaagtctttatgagctcagttttgtattgtgtaaaatgagagttacagtaatacctagattgcagggtgggtggcgaggaccaagtgaattagtacctggaaagtgtgtaacagtttcaacatgagaagtacacaacatgagaagcagagttagctgtacattgccagagaaccccctgtgggccatttcctgtgttcttgaagaagacttgggcttggaccctgtccccaggaggtctcagagtaatcaggacggtactagggagagaactgtggcaagatagatcagttatctcggtatctattctccccttcctaatgtagaagctctgatttttagctgggcagatgactacatggattcaaggtattttcctagtgtctcttgaaattaggtgtggtattgtgaccaaattctagccaaaaagatgttgaacagaagtggtatatgcagcttctaggaagtgttcttaagggggaaggcgtcatcccccacctttcctccttcctgcactctggaatgtggaccagatggctggagtaggagctgccacctggggccagaaaatgatcttaggcgtgaaggtcaagtaaggcaggacaagagagaaggagcctgcctccccgaggctgtgaagagccatgccagtactgtcacctgggagaattaaactggtcaagtgccagttcgtttag

SEQ ID NO: 736670 - DNA, 1526 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtgagtctctgcctccttggaagctccaagctcccatctcagctccaaccttctctaaagcctcagactccttttggtctagctggggcccaaatgcccctgaactctctccactcccactcctgcttaccacctgataggccacatcctcgagagttggtctctggacacggccacgtgtcagtttacccacctctgcccccttgctcacttaggaattgagatgatgacaggtcctccttcccactggttaatgtgaggatttaaaagaattatcacacataaagtgcttagagcaaaatctggaacataaaaactttcagcaacttacatctgatggtatctccagcctgtcccaggtccagtgcctttggcagataaaccacctcagttttcagcctcctgctcgtctactttgcaaacgattgaccgtcaagcccgggtttgagcctgactcactccagaactctggtttatggctgtacacttgcttagatacttacactggcccccaccgcctttgatcgaagcaattgctgctgaaaaataaagcctttctgtggctctagacctgcctcttagttaagcagttttttgtttgtttgttttttgagataggatctcgctctgtcatccaggctgaagtgcactggtgcagtcatagcccactgcagcctcaacctcctgggctcaagcattcctcctgccttagcctctcaaatagctgggaccacaggtgtgcaacaccacgctgggctcattttttatttttggc

SEQ ID NO: 736671 - DNA, 2981 bp, Homo sapiens
  misc_feature (2641)..(2643): n is a, c, g, or t
  misc_feature (2648)..(2648): n is a, c, g, or t
  misc_feature (2652)..(2652): n is a, c, g, or t
  misc_feature (2655)..(2655): n is a, c, g, or t
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactggtaagacctagaaagcacggagccctagcaggagggtggactttgaggacaggcactgggcctgtgggcagcagcttctgggagggggaggtaccttggcattgtgggcagagagagggctctggttctgattcttgcctgttcctgttttcctagttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagtaaaaaaaaaaaaaaaaaaaaaaaaaaaaannnaaacnaaanaanaaaaagaaaagcagaaagaaagagcgagagagaaccagaaaagaagaaagagagagcgaggaggtgaggggcggggggcggaggacgaagagtgagcagcagaggtggggggagcggcgggggacgaaagacagacgagcgtagggaggagcgagagcaccagcagcggcgcgcggaagaaggagggggggtagcccaaaaagaaagaaagcagaggggggggagagaagagggggggaagaagacaggcagagagacaggggagagaccgcggaggacaacgaaggaggcgggagaacaagggcggagaagtaagtgtcgcggca

SEQ ID NO: 736672 - DNA, 2487 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagtaaggtcaacacacagaaaccaacaaataaaaa

SEQ ID NO: 736673 - DNA, 2825 bp, Homo sapiens
  misc_feature (2485)..(2487): n is a, c, g, or t
  misc_feature (2492)..(2492): n is a, c, g, or t
  misc_feature (2496)..(2496): n is a, c, g, or t
  misc_feature (2499)..(2499): n is a, c, g, or t
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagtaaaaaaaaaaaaaaaaaaaaaaaaaaaaannnaaacnaaanaanaaaaagaaaagcagaaagaaagagcgagagagaaccagaaaagaagaaagagagagcgaggaggtgaggggcggggggcggaggacgaagagtgagcagcagaggtggggggagcggcgggggacgaaagacagacgagcgtagggaggagcgagagcaccagcagcggcgcgcggaagaaggagggggggtagcccaaaaagaaagaaagcagaggggggggagagaagagggggggaagaagacaggcagagagacaggggagagaccgcggaggacaacgaaggaggcgggagaacaagggcggagaagtaagtgtcgcggca

SEQ ID NO: 736674 - DNA, 3740 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagtaaacaccacaacacacagaaaggacaacaacaacgaaaaccatacacaaaaacgaacacacgaaacaaagaaaacagacaacagcaaagtacagcatacaaaacatacgaaacggggggcgccacaaaacacacgcaggatgacagaatacccattttgtaaagacaaccacagacttcaaacacacgcgcccaaaccgcggacacacgtagtttgtggacctcgggcgtacagacaccacacgcgtaatttttcttcgtgcttctttttctttctcttttcttcatttgttgcttccctctgctcccgtcaagagccacaagaaggagagagaaacagcaacaagaaagagcacagaagaggagaagcacgaaagagagggaaagaaaacaaagaaaaagaaagaaagaagaaaacaaagagagaagagggagagaggaaagcggcgaggacagagggcaaaaagcggagaaaaaaggagagaggaaagagaagaggaaggagaagacgacagacagaggagaaaagaaaaacgaagaagaggaagcgacacagccgaggaggagaagacaaacgaaggtaaggagaaggagagcagagggcgggagagagaagaagacagaagcgaagcgaagacaggagcaggaacgagaacgggaggaagaaagagaggggaagggacaggaggacagcaacaagcacaacagaaagcagagcgggagggaggcgaacggagctgagaggaaagcgcaaacgcagaaagcaaagcagaggagacgaggagaagcggacgagagaagcacagaagagggggccgcagagaaaggaggagaaagacagagagaacaagagagagaaagagaggaagaggagagagagaggcgaggggagggagagcgagggagagaggaagcgcgagagcgcagcaggcggacgagagagcggagcaaagagaggaagagagctggcggccggcgtggaacgaggaacaggatggggcaatgaggacagaagagcaggacgacagcggaagaacagaaagaaggcgaaagacaggcaacgcgacgagacgagaggaagcgcagcacgagagaccagaccacgcagcagacgacaggagagacgagagcgaggcgagagcgcgcagacgcagacaagaacgcgcgcagaacgagagaaacgacgtgaacagcagcaacccgaggagggcaagaacaaggaggagagagaaaacaagagaggcgaagagagagacgcacagaaaagaacgcgaggcacacagagc

SEQ ID NO: 736675 - DNA, 2417 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtattctgccggaacctctagagtcacctcagc

SEQ ID NO: 736676 - DNA, 2433 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtaaatggtgtgtcaaaaaaaaagaaaaaaggggggccgatcaagaatt

SEQ ID NO: 736677 - DNA, 2366 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctccccatatctaacaacgtaaatataatatgacagtt

SEQ ID NO: 736678 - DNA, 2389 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgccaaaccggccagtcacgagagaattagcatccggtacaggacccgcggggaaggaaacctcccaataaattaaacccggacccaaaaagggaaaagggcggcgcatatcacctctcccctcgc

SEQ ID NO: 736679 - DNA, 2221 bp, Homo sapiens
  misc_feature (2012)..(2012): n is a, c, g, or t
  misc_feature (2018)..(2018): n is a, c, g, or t
  misc_feature (2039)..(2039): n is a, c, g, or t
  misc_feature (2049)..(2050): n is a, c, g, or t
  misc_feature (2058)..(2058): n is a, c, g, or t
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgtctgctctcngctgangcggagaggagcaactggccnggggcacccnnacccaaancccttgggacacgggggctgcggaccgggagggtggccagcctccgaggggcacacacccgggggagtcaggcccacgggggcagggggacaaccggcgagggccccggagagacgcggagcgggagccacccgccggggggccccacaagaggggaggagat

SEQ ID NO: 736680 - DNA, 2048 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcttgatactggacgacggggatcctctggaacga

SEQ ID NO: 736681 - DNA, 1976 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatccgagcagtgtaaggatccgctagagtacctcagcacac

SEQ ID NO: 736682 - DNA, 1947 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagtccgatttccagtttatgggtcctctagatcgacctg

SEQ ID NO: 736683 - DNA, 2453 bp, Homo sapiens
  misc_feature (2113)..(2115): n is a, c, g, or t
  misc_feature (2120)..(2120): n is a, c, g, or t
  misc_feature (2124)..(2124): n is a, c, g, or t
  misc_feature (2127)..(2127): n is a, c, g, or t
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcacggttcctcctctccccagcctgggaagatgtctcactgtccacctcccccatttacttctccacctcccgtcctccccatcattggtttttttttgtgtgtcaactgtgccgtttttattttattccttttattttcccccttttcacagagaaataaaggtctagaagtaaaaaaaaaaaaaaaaaaaaaaaaaaaaannnaaacnaaanaanaaaaagaaaagcagaaagaaagagcgagagagaaccagaaaagaagaaagagagagcgaggaggtgaggggcggggggcggaggacgaagagtgagcagcagaggtggggggagcggcgggggacgaaagacagacgagcgtagggaggagcgagagcaccagcagcggcgcgcggaagaaggagggggggtagcccaaaaagaaagaaagcagaggggggggagagaagagggggggaagaagacaggcagagagacaggggagagaccgcggaggacaacgaaggaggcgggagaacaagggcggagaagtaagtgtcgcggca

SEQ ID NO: 736684 - DNA, 1737 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccattaaaaagacggccagtcgtatgggcggccgagggaagatgcgggggaaagtgcagccaagcctcgcgatgttgcccatgcacggagagcgattaaccagc

SEQ ID NO: 736685 - DNA, 1758 bp, Homo sapiens
  misc_feature (1559)..(1559): n is a, c, g, or t
  misc_feature (1577)..(1577): n is a, c, g, or t
  misc_feature (1605)..(1605): n is a, c, g, or t
  misc_feature (1607)..(1607): n is a, c, g, or t
  misc_feature (1610)..(1610): n is a, c, g, or t
  misc_feature (1612)..(1614): n is a, c, g, or t
  misc_feature (1618)..(1618): n is a, c, g, or t
  misc_feature (1621)..(1621): n is a, c, g, or t
  misc_feature (1624)..(1624): n is a, c, g, or t
  misc_feature (1636)..(1636): n is a, c, g, or t
  misc_feature (1639)..(1639): n is a, c, g, or t
  misc_feature (1647)..(1649): n is a, c, g, or t
  misc_feature (1653)..(1653): n is a, c, g, or t
  misc_feature (1664)..(1664): n is a, c, g, or t
  misc_feature (1666)..(1666): n is a, c, g, or t
  misc_feature (1671)..(1671): n is a, c, g, or t
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggnattccttgatgaagaacntaactcccttgggcatgggcctggcctngnggnannntggnatntgnccatcccccganggnagcccccnnncaancctggaaaaancntaggngggaaaaagattttgggaaaagaaatggggggcccccagtgcccacaaatcggttccgccacagggtccctgtgggccatgtgttcc

SEQ ID NO: 736686 - DNA, 2332 bp, Homo sapiens
  misc_feature (1992)..(1994): n is a, c, g, or t
  misc_feature (1999)..(1999): n is a, c, g, or t
  misc_feature (2003)..(2003): n is a, c, g, or t
  misc_feature (2006)..(2006): n is a, c, g, or t
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagtaaaaaaaaaaaaaaaaaaaaaaaaaaaaannnaaacnaaanaanaaaaagaaaagcagaaagaaagagcgagagagaaccagaaaagaagaaagagagagcgaggaggtgaggggcggggggcggaggacgaagagtgagcagcagaggtggggggagcggcgggggacgaaagacagacgagcgtagggaggagcgagagcaccagcagcggcgcgcggaagaaggagggggggtagcccaaaaagaaagaaagcagaggggggggagagaagagggggggaagaagacaggcagagagacaggggagagaccgcggaggacaacgaaggaggcgggagaacaagggcggagaagtaagtgtcgcggca

SEQ ID NO: 736687 - DNA, 1403 bp, Homo sapiens
  misc_feature (1250)..(1250): n is a, c, g, or t
  misc_feature (1253)..(1253): n is a, c, g, or t
  misc_feature (1255)..(1255): n is a, c, g, or t
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaagggaacctnggngntcccgaatgcccaacccaacctggccaagatctggccccgtggctcctcaaagcctctttgggggggccgcctttccccacaccttctgggggtaaagagacaaacacaatcctccggagacacccctctttttgggccccctccttt

SEQ ID NO: 736688 - DNA, 2942 bp, Homo sapiens
  misc_feature (2602)..(2604): n is a, c, g, or t
  misc_feature (2609)..(2609): n is a, c, g, or t
  misc_feature (2613)..(2613): n is a, c, g, or t
  misc_feature (2616)..(2616): n is a, c, g, or t
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtgggctgacaagttcacagagctccagaaagcagtggggcctgagatcaccaagacagacctggtccctgccttccagaacctgatgaaagactgtgagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactggtaagacctagaaagcacggagccctagcaggagggtggactttgaggacaggcactgggcctgtgggcagcagcttctgggagggggaggtaccttggcattgtgggcagagagagggctctggttctgattcttgcctgttcctgttttcctagttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagtaaaaaaaaaaaaaaaaaaaaaaaaaaaaannnaaacnaaanaanaaaaagaaaagcagaaagaaagagcgagagagaaccagaaaagaagaaagagagagcgaggaggtgaggggcggggggcggaggacgaagagtgagcagcagaggtggggggagcggcgggggacgaaagacagacgagcgtagggaggagcgagagcaccagcagcggcgcgcggaagaaggagggggggtagcccaaaaagaaagaaagcagaggggggggagagaagagggggggaagaagacaggcagagagacaggggagagaccgcggaggacaacgaaggaggcgggagaacaagggcggagaagtaagtgtcgcggca

SEQ ID NO: 736689 - DNA, 2434 bp, Homo sapiens
  misc_feature (18)..(18): n is a, c, g, or t
gattcttgggttccgcgngtagtttcggaaggagacatcgaagcagggcgaggcgcagagggcgttgcggactcatgccccagtcggcagtgcggggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacccggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcaatggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctcccgcccttgtgccccacaacctggccaacagtactggaagaaactggacacagtcaccagcatcccaggggagggcaaaacagccatgtcgtgccctgatgaagagcaattctgatcacagctgttactcactgagcaccagccaggcaccaggcacccccataacacggcttcctgtgctctccctccagagcctgtcgcagctctaggagggagctatacaatgatgtctttattagtgtcatcatgagaagcccaataagcagtatgccctaacagttagtaggccaggctctggagctaagctgcatgggttcaaatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccattcagcctgcagagactgtgggtgagttacttgagctctctgtgccaatattttctcacctataaggtggaggtgaaaataaactctataacatgacaagaactacttcacagtagttgcagtgaggattcaacgagatgaacatttagtacttgggacacagcagtggcccagtgtaaatgggctacttgtcataagccctaagtcacaggtcaacaaactgagaggcaaaagcacttggttgagcttgtgtatctagtgagtatggattcagggaccagattcccagccccacgaactgctaagcaaccccacctcctaaacacatgagtgccgattaacttcacagaaaaacacacaaggcaaagttcagcgaggtgaaattctccaagctataaagatcagggaagacttcctggaggaattcacccttgagcaaaatcctaaaggatcaatagtagctggcaaaaagaagcaggaggaagcgcattctaggtagaggagacagcctggacaaaggtctgagggaggaaggaacacaaggagtgcaggacactttcataactgcatgaacttcatagagatgggatcctttagcatgttctctgtgcacatgcttgaccatgttctttcacatgctttttgccacttgatctttccagcaactcagtgagagaagcaaaaaagtaagttgcatcctgctattgtctgaatgtttgtgtctccccaaaattcatcttttgaaacctaattaccaaagtgatattactgggaggtggggcctttgggaggtggtgagatcatgagggtggagcccccatgaataggattagtgcccttataaaagaggccctggagagctgccttgccccttccaccacatgagaacacagccagcaggtgcctataagcaagaaagtgggttctcaccagccatcgaatctgctggtgcattgattgcagacttcccagactccagagctatgagacataaatttctgttgtgtataagccat

SEQ ID NO: 736690 - DNA, 2449 bp, Homo sapiens
agctgtcccaggtggcccagctcagcaatggcaatgggggtccccagagtcattctgctctgcctctttggggctgcgctctgcctgacagggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacccggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcaatggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctcccgcccttgtgccccacaacctggccaacagtactggaagaaactggacacagtcaccagcatcccaggggagggcaaaacagccatgtcgtgccctgatgaagagcaattctgatcacagctgttactcactgagcaccagccaggcaccaggcacccccataacacggcttcctgtgctctccctccagagcctgtcgcagctctaggagggagctatacaatgatgtctttattagtgtcatcatgagaagcccaataagcagtatgccctaacagttagtaggccaggctctggagctaagctgcatgggttcaaatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccattcagcctgcagagactgtgggtgagttacttgagctctctgtgccaatattttctcacctataaggtggaggtgaaaataaactctataacatgacaagaactacttcacagtagttgcagtgaggattcaacgagatgaacatttagtacttgggacacagcagtggcccagtgtaaatgggctacttgtcataagccctaagtcacaggtcaacaaactgagaggcaaaagcacttggttgagcttgtgtatctagtgagtatggattcagggaccagattcccagccccacgaactgctaagcaaccccacctcctaaacacatgagtgccgattaacttcacagaaaaacacacaaggcaaagttcagcgaggtgaaattctccaagctataaagatcagggaagacttcctggaggaattcacccttgagcaaaatcctaaaggatcaatagtagctggcaaaaagaagcaggaggaagcgcattctaggtagaggagacagcctggacaaaggtctgagggaggaaggaacacaaggagtgcaggacactttcatgagtgcaggacactttcataactgcatgaacttcatagagatgggatcctttagcatgttctctgtgcacatgcttgaccatgttctttcacatgctttttgccacttgatctttccagcaactcagtgagagaagcaaaaaagtaagttgcatcctgctattgtctgaatgtttgtgtctccccaaaattcatcttttgaaacctaattaccaaagtgatattactgggaggtggggcctttgggaggtggtgagatcatgagggtggagcccccatgaataggattagtgcccttataaaagaggccctggagagctgccttgccccttccaccacatgagaacacagccagcaggtgcctataagcaagaaagtgggttctcaccagccatcgaatctgctggtgcattgattgcagacttcccagactccagagctatgagacataaatttctgttgtgtataagccat

SEQ ID NO: 736691 - DNA, 973 bp, Homo sapiens
ttttaaaatgaaagggtgactcatgggagaagcctctggaactgcctttgaaaaacaaccagccaagacatgagaaattagttcctctgccatttgggggtttcctgccaactgctgggttttccttttgcacagcagggaggaaggacgcctgtttcccttggtcccggtgaggccaggcctcagcttcctgcccacccgccactgctgctggggcagggaggcagtttccggctgtggggacccagacaatgcctggccaaggcaccatcgtcctcttcctggacacagctcccgcctcatcccagggtctggcctgggacacgccctagaggccctcagccctgagtcactgcaccatgcagatccaccctgattctggtccctgcagagcaggctcctacacaaggcaagaagatgctccagggacaagccaaggtgtatgcaaggcccaggtgcctgagaaacacgtctcaccgaccttggggcaggggctgttacaagaggcttatagtctagtggcagagacaaaaaccacactcaaatcattagtgtacggtatgcactgctcagggactcaaatatgtgacaggaggctccaaacaagagcggagacaaggcgtaaatagccccctgtggactggatgttctgactcctggatggcctccagaaggatgccttttacggtctgtgaaagagctcagggaccaagatgctcaaagcccttcatgcccaagagcccctcctcaggctgggacacgggaagcagagctcggaggtggaactcgtgactgtgtatgggcacatgtgagtgcgtgtgtgtggacagccaggcttagtgtagacaacgtgtgaggctcagaccccaagtgctgactacacctatgcacatccccacctgcgtgtgaaagaagatgctagaaaagaacaaaaataacttaaaaaataaatccaataagatggctggaacat

SEQ ID NO: 736692 - DNA, 403 bp, Homo sapiens; identical to SEQ ID NO: 62192
  misc_feature (299)..(299): n is a, c, g, or t
  misc_feature (310)..(310): n is a, c, g, or t
  misc_feature (332)..(332): n is a, c, g, or t
  misc_feature (371)..(371): n is a, c, g, or t

SEQ ID NO: 736693 - DNA, 585 bp, Homo sapiens
  misc_feature (294)..(294): n is a, c, g, or t
tcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcnctcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatcttt

SEQ ID NO: 736694 - DNA, 1892 bp, Homo sapiens
aacctgggatgtgcaccaaccccggagagcgagatcaaagggattggaaacagactggggactggcggggggagggggccggccagcctgtggagtcctccctgagaagcggagggcccggcttccaccgtgactccagcggcctgcttggggttttaattattattttgaaatttctgaatcgagctagagcgagagagcgagagatctccgtagactgcgactcgctggctttcgctccgagatgatgcagagtgcgactgtccccgcggaaggggctgtcaaggggctcccggagatgctaggtgtgccgatgcaacagattccccagtgcgctggctgcaaccagcacatcctggacaagttcatcctgaaggtcctggacagacactggcacagctcctgcctcaagtgtgcagactgccagatgcagctggcggacaggtgcttctccagggctgggagcgtctactgcaaggaggacttcttcaagcgcttcggcacaaaatgcacggcctgccagcagggtatccccccaacccaggtggtccgcaaggcccaggactttgtctaccacctgcactgctttgcttgcatcatctgcaaccggcagctggccacgggggacgaattctacctcatggaggacgggcggctggtgtgcaaggaagactacgagacagccaagcagaacgatgactcagaggctggagctaagcggccccggaccaccatcacagccaagcagctggagacattaaagaatgcatacaagaactcccccaagcctgcccggcacgtgagggagcagctgtcctcagagacaggcctggacatgagggtcgtacaggtttggtttcagaacagaagggccaaagagaaacgcctgaagaaggatgcagggcggcaccgctgggggcagttctataagagcgtcaagaggagccggggcagcagcaagcaggagaaggagagctctgcagaggactgtggggttagtgacagtgagctgagcttccgagaggatcaaattctctcagaacttggccacaccaataggatttatggcaacgtgggggacgttacaggcggacagttaatgaatgggagcttctccatggacgggacaggacaatcctatcaggacttgagggatgggagcccctatggaatcccccagtctccatcctccatatcgtccctgccatcccacgctcctttgctcaatgggctggattacacggtggacagtaatttgggcatcattgcgcatgcagggcagggagtaagccagacgctgagagccatggctgggggacccacctctgacatctccacaggaagcagtgtaggctatcccgactttccaactagcccaggctcttggctcgatgaaatggatcatcctcctttttaaacttctctcctccccaccctacctgcccccctggcttgagagaatatcttcaaggatcaaaagagacttgccttttaaggatcgaaagtacgccaatgtgaatttccattattttcaatggaagtcctccgctgattcctagaaggctgtgagaccacactagggcattgtttccctggggaagcagtgggagagcagactcatctcagaacacagcacagggggtaatggcctagagctctagggacactggcttgttgggtctctcccctgctgttctgcttaggggcttggctgctcagtgctttggtagcacaaggtgactgtgataggcccccttggcctttgggaactttgctccaactggtgtgtctcacacaatgcctcccaaaacactgctctcaccagaactgagactcctaaggtagaggcctcacagcccttgagtaaaataaaagtgatttctggaccatcc

SEQ ID NO: 736695 - DNA, 1626 bp, Homo sapiens
ctgttgggtgcaggtgggtccctgggctgacctatcattggtttctctgggaataatttctcaaagactaaaactgctcacctctgttggagagagaaattctttcaagtggcaaagattccattagatccccttaatgaaattctttaagaaaaaagaaggttcatttgccttaatcaagtcaattctttgtccccagtgaagagcttattgaatacagacagaaaccaagtcctttgatattgaacctctcttccagatagaccagaaggattttgtacagatgtctaagagtggtcctcagcttccctgaccatatgggcctgcttgcttcccaatcaactaaaccaagccctttctcagcttgaaagctttcagggtaaatgttgtcagcatgtagtttccatttgtgatgtggagacatctgacccacccagccttaggcattcatcctcctcagtgtagccagagtattagtacacgagccacaagggaccaacgagctcaccaaacatttgtccatccttctgggacctgggaatttagtctttgcaggtgtttcttgtttttctccttggcctgggttggcctctggatatcaggctgccatattggtgtgtctgacccatgcttggctgcaaggcagctgccatccttgggcatctttcctggtcatgtgtgttcctaggttgtgaagagcaggggaccatcagagtcctggcagctgacaataaatctccgttcttttgtccacagaggatcaaattctctcagaacttggccacaccaataggatttatggcaacgtgggggacgttacaggcggacagttaatgaatgggagcttctccatggacgggacaggacaatcctatcaggacttgagggatgggagcccctatggaatcccccagtctccatcctccatatcgtccctgccatcccacgctcctttgctcaatgggctggattacacggtggacagtaatttgggcatcattgcgcatgcagggcagggagtaagccagacgctgagagccatggctgggggacccacctctgacatctccacaggaagcagtgtaggctatcccgactttccaactagcccaggctcttggctcgatgaaatggatcatcctcctttttaaacttctctcctccccaccctacctgcccccctggcttgagagaatatcttcaaggatcaaaagagacttgccttttaaggatcgaaagtacgccaatgtgaatttccattattttcaatggaagtcctccgctgattcctagaaggctgtgagaccacactagggcattgtttccctggggaagcagtgggagagcagactcatctcagaacacagcacagggggtaatggcctagagctctagggacactggcttgttgggtctctcccctgctgttctgcttaggggcttggctgctcagtgctttggtagcacaaggtgactgtgataggcccccttggcctttgggaactttgctccaactggtgtgtctcacacaatgcctcccaaaacactgctctcaccagaactgagactcctaaggtagaggcctcacagcccttgagtaaaataaaagtgatttctggaccatcc

SEQ ID NO: 736696 - DNA, 1065 bp, Homo sapiens
  misc_feature (230)..(230): n is a, c, g, or t
  misc_feature (260)..(260): n is a, c, g, or t
  misc_feature (545)..(545): n is a, c, g, or t
tgtggaattgggtacattcaatctgatgagacttctgtgcagctgggctggcaggggagggttgaggcagggagctgagcagagaaaggactgctgtcctcacttttcagtggcttgggaaggcccgtggtgcaggagtcagtgccatgagagtggggacctctccactctgatgtcccctgtgcctcgcgctgtcctgcctacagcaggcaggcttaggtgcagaaagnatggaagggagggtgtgggaggaggcgcanctgctgcagataggccgaagccagtaagcagtggtttttccttgcagatgactcagaggctggagctaagcggccccggaccaccatcacagccaagcagctggagacattaaagaatgcatacaagaactcccccaagcctgcccggcacgtgagggagcagctgtcctcagagacaggcctggacatgagggtcgtacaggtgagatgccagcactcctgtgccctccggggatcccaggcccgggacaggggtggaaggtatcctgagtgacatcagctcangggtggttgggctcagggcttgaccccagggcttttgccagaactgaagacagagttctgaggcccacctggggaaaaaggggtggggccgcatcgcactccccaagacctgtgctcccattcaggcttcagtctgcttcccagccgcccgccctagggggtccctgggggctttgggtttgtggtggacgccccctgagtatgtcccttgtgcttgtgtggcaggtttggtttcagaacagaagggccaaagagaaacgcctgaagaaggatgcagggcggcaccgctgggggcagttctataagagcgtcaagaggagccggggcagcagcaagcaggagaaggagagctctgcagaggactgtggggttagtgacagtgagctgagcttccgaggtgagcagggctggaggggccagccgaggccttaggaaagtcccctgggaatctgtaatccctggcactcaggagggatctttcttgaggccttggcaactccctcctgaacacaggcttttc

SEQ ID NO: 736697 - DNA, 1450 bp, Homo sapiens; identical to SEQ ID NO: 62632

SEQ ID NO: 736698 - DNA, 304 bp, Homo sapiens
gagcttgcctgccagaagctcctctcccagcctgcgagcatttccaggctcttgtttcccatcagcctctgggtccaaactaaccacaggtctctgggtccttttccggtgtccttaaggttcttggactctgcatgtgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctgatttggagtcaaaaacgtatgag

SEQ ID NO: 736699 - DNA, 1674 bp, Homo sapiens
gagcttgcctgccagaagctcctctcccagcctgcgagcatttccaggctcttgtttcccatcagcctctgggtccaaactaaccacaggtctctgggtccttttccggtgtccttaaggttcttggactctgcatggttccctttagcctgtcttcgggcctgccacaattaaatgaccgcaagaaagaagtctatgctaagccccataatgaacgtttcaagcaagaaggatgagaattttagatctggaagtgtccgcgggacaggatcttgtcaagacctgatggggaagttctagagtgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctgttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttgtacgtggatgtaatgttggagaactatagtaacttggtgtcactgggtaaggtcatctgcctgaaataatttagagtctcctctttgcatcatcagttttctgcactggaaattacagggctatctttgaagaaaccaggtgaatttcttctcccccttcccaagggcatgcttttatacttgctgggttagaaatgggtttgttaaacacgttgatcttccccatccctcagtgagctttacaccattctcgggccctccctgcaatcacctctctcctttaatggccaaggggctggatttgcattatagaacatttatttcataactatggcaaagaaaccagatttcataaattctgcaaatattatattgaatatctactcctggccagccttgtgctgagcactgtcaattgaatcatgaacaagctttgataacttgcccattttcgtgcagtttactttgtagtaaagcagaaacatcaaataagtaaatttataaatagataaatagtatgtaatgaagcaaattctttggaaaaggtaaacagcataagggaatagaaaatgatgaggactgacagggctaatttaggtaagacagtcggggaacgctttcttgaacagagatgtggagcctgggatctctatgtgaatatctggcggaggaacagatcagtcacagtgaacagcaaatgcaaagaccctgttgttggaaaggaactttaccagaactctagagtagagttattaaaggaacatgtactaagaaattaggccagggagataggaaggggccagataatacattgttttgttgttcttgtttgtggaatttggattgtttagtctctttcagtctgaaacagttcacatgtctttccttgacttgcgtatatgtctgtgatgcttttgaagattacaggccagctattttgtatagtgttcctgaatgtgggtttgtctgctatttcttcatgattagatttagaatatggatctttggcaggattatcacagaattgatgctgcgttcttctccctgcattttgttggg

SEQ ID NO: 736700 - DNA, 1610 bp, Homo sapiens
gagcttgcctgccagaagctcctctcccagcctgcgagcatttccaggctcttgtttcccatcagcctctgggtccaaactaaccacaggtctctgggtccttttccggtgtccttaaggttcttggactctgcatggttccctttagcctgtcttcgggcctgccacaattaaatgaccgcaagaaagaagtctatgctaagccccataatgaacgtttcaagcaagaaggatgagaattttagatctggaagtgtccgcgggacaggatcttgtcaagacctgatggggaagttctagagtgctgccaggttgccagatttctaagaaggagtttgaagaggagaaaaggatttttgcatgtttagaaatcaaggttcagttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttgtacgtggatgtaatgttggagaactatagtaacttggtgtcactgggtaaggtcatctgcctgaaataatttagagtctcctctttgcatcatcagttttctgcactggaaattacagggctatctttgaagaaaccaggtgaatttcttctcccccttcccaagggcatgcttttatacttgctgggttagaaatgggtttgttaaacacgttgatcttccccatccctcagtgagctttacaccattctcgggccctccctgcaatcacctctctcctttaatggccaaggggctggatttgcattatagaacatttatttcataactatggcaaagaaaccagatttcataaattctgcaaatattatattgaatatctactcctggccagccttgtgctgagcactgtcaattgaatcatgaacaagctttgataacttgcccattttcgtgcagtttactttgtagtaaagcagaaacatcaaataagtaaatttataaatagataaatagtatgtaatgaagcaaattctttggaaaaggtaaacagcataagggaatagaaaatgatgaggactgacagggctaatttaggtaagacagtcggggaacgctttcttgaacagagatgtggagcctgggatctctatgtgaatatctggcggaggaacagatcagtcacagtgaacagcaaatgcaaagaccctgttgttggaaaggaactttaccagaactctagagtagagttattaaaggaacatgtactaagaaattaggccagggagataggaaggggccagataatacattgttttgttgttcttgtttgtggaatttggattgtttagtctctttcagtctgaaacagttcacatgtctttccttgacttgcgtatatgtctgtgatgcttttgaagattacaggccagctattttgtatagtgttcctgaatgtgggtttgtctgctatttcttcatgattagatttagaatatggatctttggcaggattatcacagaattgatgctgcgttcttctccctgcattttgttggg

SEQ ID NO: 736701 - DNA, 694 bp, Homo sapiens
  misc_feature (685)..(686): n is a, c, g, or t
  misc_feature (688)..(688): n is a, c, g, or t
  misc_feature (690)..(693): n is a, c, g, or t
gagcttgcctgccagaagctcctctcccagcctgcgagcatttccaggctcttgtttcccatcagcctctgggtccaaactaaccacaggtctctgggtccttttccggtgtccttaaggttcttggactctgcatgtgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctgatggagtctcgctctgtcgcccaggctggagtgcagtggtgcgatcttggctcactgcaagctccgcctcctgggttcacgctattctcctgcctcagcctcctgagtagctgggactacagttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttttttctgcactggaaattacagggctatctttgaagaaaccagatggagtcttgctctgtcacccaggctggagtgcagtggtgtgatctcggctcactgcaagctctgcctcnntngnnnng

SEQ ID NO: 736702 - DNA, 1981 bp, Homo sapiens; identical to SEQ ID NO: 56809

SEQ ID NO: 736703 - DNA, 730 bp, Homo sapiens
ccctcgaggccaataatgcggcacgaggcttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaaaaaaaaaa

SEQ ID NO: 736704 - DNA, 1010 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgaggtgggtccttcatccagataggggagtgcggggagggaaatccaagaggtcaaaggttagcagtcggactggggttttgaaaattgcaggttgggtaataagagactgggagtcaggtggggcgtggtggctcatgcctgtaatcccaacactttgggaggccgaggcaggtggatcactggaggtcaggagttagagaccatcctggccaatatggcgaaaccctgtctctactaaaaatacaacaacaacaaaaaaaggtagctgggtgtggtggcgcatgcctgtagtcccagctactcgggaggctgaggttgcagtgagtcaagatcaggccattgcactgcagccttggtgacacagtaagactctatctcaaaaaaa

SEQ ID NO: 736705 - DNA, 669 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtagagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcag

SEQ ID NO: 736706 - DNA, 5817 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccacaaagaaaaaaaaaacgtgtgtctgaagccagaacgggagctgttgcggcccaactccctcccctgcccccaagcggcctctgggctcgggaagggcccctgcctcctcccgccaggcacttatctctacccaggctgagtgctggccccgccccctcggggatctgccacttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaaggtaaggatgagctgcgtgtggacccctacgctggagcctgcaggaccatgctggggcctgaactcccagcctaggtcctgggggccatgcctgtttctggacttcctgaccgggtcctgggggccaagctggcatctgaacccttagactgggtcctggatgggtggggggcggggtggggtatgttaggatccaagactcctgatcgcgtcccgggcaagagctagagtgggcttaacattcccgttttaccttttcagggagtctgggacatgctaaatcctaagggggctgacttggtgctaaggtccctggggggtggggaccaagccgaccctccctaggggagggagggtaaagcccgggtccgagttagaggggccaagccacaggctactgtaaacacggtttgtgtgagggcgccagatcacttgcccggcccggtggagggagggaggcggggggcacggttggcgctatcggttggcggggagcctgccggggccgatagggggcccgcctctccgcacacacccccagccgcgcgcgtgtcctaggctggggcggggctggcagtcccgagctcgaggtcttgaacgccgcgcccagctcagctggccgctgggtgggcaggtgtgcgccagtggtgacggcgggggacagtaaggcgagaaacttgcccctgggaattaggggggcaccacctctgcggacccctccaagggacccgcttgggaagatggcagggcggggcttttttcttatcgggtccgcccaggctgcgggagggaagaggagggggctgtctcccgaggatagagctcagacccccatgcccttcctttgtcgcccctccccagcggccttgctggcggcccgggggcccgaagagcttctgtgcttcaccgagcggttggaggacttggtgtgtttctgggaggaagcggcgagcgctggggtgggcccgggcaactacagcttctcctaccagctcgatttgaggcccgacggcgcctccagtcgtggtcactggagggaaacctgcgggtccagggctggcacgccctctatgggccggggcgcgaacactcccgcgatcaccgctggaacgcgaccccaaacatcaggctgggataacaacgcctccaaatcgaggggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 736707 - DNA, 1572 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggaggtctgacccctgacccttgacccctgaccccagctccacttg

SEQ ID NO: 736708 - DNA, 1967 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagaggtgaccaccctgtagcctgtcccagccccaccccagctgagcctgggtcaccaactggattccacccactccatacacacctccagctcctcccaagaccccctcttgagccctgatcccccactacaacctgtgaccttgcagtatctccagtcgaatcaaatagactgggcctggtggtttactcgtgtaatcccagcacttgggaggccaaggtgggtggatcacttgagcccaggatttcgagaccagcctgggcaacatggcgaaaccccatatcta

SEQ ID NO: 736709 - DNA, 2684 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaaaaaaaaaa

SEQ ID NO: 736710 - DNA, 2757 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggttcccagtgacagcagaatgagcttggcttggcagtagctgcagagggacccatggctgttcaggttcgcggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaaaaaaaaaa

SEQ ID NO: 736711 - DNA, 2993 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccacaaagaaaaaaaaaacgtgtgtctgaagccagaacgggagctgttgcggcccaactccctcccctgcccccaagcggcctctgggctcgggaagggcccctgcctcctcccgccaggcacttatctctacccaggctgagtgctggccccgccccctcggggatctgccacttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgagtgagtccgatccggcgggtgcctccaagggcggagggagggggtggggcagagctccctggaggtcgtagcctcgtatgtcccctgctg

SEQ ID NO: 736712 - DNA, 3509 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccacaaagaaaaaaaaaacgtgtgtctgaagccagaacgggagctgttgcggcccaactccctcccctgcccccaagcggcctctgggctcgggaagggcccctgcctcctcccgccaggcacttatctctacccaggctgagtgctggccccgccccctcggggatctgccacttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtgaggccagcccctacggcccagcccccaaagctccactgactacggcccagccacgcctctcgaggtcgcgcccggtgccgctttcagggccggtccgtaacatcccacatcccattaccctggtgctgaagaccgttccacgcccacagacacaccccctttcctaatgtcctcgcaagcctgttgaaccccaacttcttctccctccggcccgtaaccctagacccctttagcgcccgggtccctctacgagtgctagcccagatatt

SEQ ID NO: 736713 - DNA, 4207 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccacaaagaaaaaaaaaacgtgtgtctgaagccagaacgggagctgttgcggcccaactccctcccctgcccccaagcggcctctgggctcgggaagggcccctgcctcctcccgccaggcacttatctctacccaggctgagtgctggccccgccccctcggggatctgccacttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagaggggcaccgttttcctttcccctgattggctcagttccaccagggcccgcccccacgtcatctatttttgtctgctacgcgtccctcgccctgattccgcccccaggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcggtgaggccccaggcgggggtgtaggaggagccagggcgaatcacggggcaagcccaccgccctgacctcctccccgcctcttagacctggaccccctcatcctgacgctctccctcatcctcgtggtcatcctggtgctgctgaccgtgctcgcgctgctctcccaccgccggtgagctccccatttgggcgctgggcccagactcctccccgccaacggtcctctttcactatggaaacctaggctcagagagagacacgcacttgcccaaggtcacgcagtaaggattcacatcagtggcagggctgggatgcatgccagactagacccagactcttcgttaacattttctgctcttggggactttcacctgattttccttctacatcaggggctgccatttcttgggtccctttgttagttcctttccccagtgtcatcacctttgtaaaatcaactagatggatttagtgaaagaatttaagaccctgaatgcctccgcacccctgcggtcaagcttctcagacactatgatcagactagccgttctgaggtatttgtaattccaagcacacactaggtggtttcacacccccaagcttttgcccatgctgttccctctgcctggaatgcccttcctgccttgtctgctaagcaatcttctagtcgtctttcatggccctgttcatttacttggttggaaaatacaaa

SEQ ID NO: 736714 - DNA, 5250 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccacaaagaaaaaaaaaacgtgtgtctgaagccagaacgggagctgttgcggcccaactccctcccctgcccccaagcggcctctgggctcgggaagggcccctgcctcctcccgccaggcacttatctctacccaggctgagtgctggccccgccccctcggggatctgccacttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagaggggcaccgttttcctttcccctgattggctcagttccaccagggcccgcccccacgtcatctatttttgtctgctacgcgtccctcgccctgattccgcccccaggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcggtgaggccccaggcgggggtgtaggaggagccagggcgaatcacggggcaagcccaccgccctgacctcctccccgcctcttagacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccaggtaggtggcctggttgtcccctcagtgcctgggcttccctgcttcttgcagccaaactgcaggcctctctgagcaggttggtgctatttcttcagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 736715 - DNA, 5155 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccacaaagaaaaaaaaaacgtgtgtctgaagccagaacgggagctgttgcggcccaactccctcccctgcccccaagcggcctctgggctcgggaagggcccctgcctcctcccgccaggcacttatctctacccaggctgagtgctggccccgccccctcggggatctgccacttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagaggggcaccgttttcctttcccctgattggctcagttccaccagggcccgcccccacgtcatctatttttgtctgctacgcgtccctcgccctgattccgcccccaggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcggtgaggccccaggcgggggtgtaggaggagccagggcgaatcacggggcaagcccaccgccctgacctcctccccgcctcttagacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 736716 - DNA, 5174 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccacaaagaaaaaaaaaacgtgtgtctgaagccagaacgggagctgttgcggcccaactccctcccctgcccccaagcggcctctgggctcgggaagggcccctgcctcctcccgccaggcacttatctctacccaggctgagtgctggccccgccccctcggggatctgccacttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagaggggcaccgttttcctttcccctgattggctcagttccaccagggcccgcccccacgtcatctatttttgtctgctacgcgtccctcgccctgattccgcccccaggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcggtgaggccccaggcgggggtgtaggaggagccagggcgaatcacggggcaagcccaccgccctgacctcctccccgcctcttagacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccaggttggtgctatttcttcagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 736717 - DNA, 5071 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccacaaagaaaaaaaaaacgtgtgtctgaagccagaacgggagctgttgcggcccaactccctcccctgcccccaagcggcctctgggctcgggaagggcccctgcctcctcccgccaggcacttatctctacccaggctgagtgctggccccgccccctcggggatctgccacttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagaggggcaccgttttcctttcccctgattggctcagttccaccagggcccgcccccacgtcatctatttttgtctgctacgcgtccctcgccctgattccgcccccaggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 736718 - DNA, 4967 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccacaaagaaaaaaaaaacgtgtgtctgaagccagaacgggagctgttgcggcccaactccctcccctgcccccaagcggcctctgggctcgggaagggcccctgcctcctcccgccaggcacttatctctacccaggctgagtgctggccccgccccctcggggatctgccacttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 736719 - DNA, 2349 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtctgcaataaagattgagtttgc

SEQ ID NO: 736720 - DNA, 2369 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgggagaagactgcgcctcttcatgtataaaatccctgttctttctctgccaccctggcgtagattat

SEQ ID NO: 736721 - DNA, 2636 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaaaaaaaaaa

SEQ ID NO: 736722 - DNA, 2209 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgtgccctgagcctgtgacctgctccagatcgcccggcccgttcgtctttggcctctgtggcagcacctcagaatcccccatcccgggtgcagtagagtctcggatggcccgatgtcatcgcgcgatcacggatcgaacagatgaccagcgggagaccatgtgatctgacagcatacttgcatgaccagagtcaggacgagaagctccgccattagtgagtcgcggctgagcccttgctagtagagcaacacattgtagca

SEQ ID NO: 736723 - DNA, 1677 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccacagtcgaacgggatactctagagtcagccggaccgatcaactcgccgc

SEQ ID NO: 736724 - DNA, 5827 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccgggtcagtagcgaaccataacctccgtattctccaccctagaaccccaactgggcacccccctccacctcctcaggtgtggaacctggaaacacctcccagacccagagccctcttcctaagcccccttctaggttcccccttcttcacctgctggggggcctcttcccagggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccacaaagaaaaaaaaaacgtgtgtctgaagccagaacgggagctgttgcggcccaactccctcccctgcccccaagcggcctctgggctcgggaagggcccctgcctcctcccgccaggcacttatctctacccaggctgagtgctggccccgccccctcggggatctgccacttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaaggtaaggatgagctgcgtgtggacccctacgctggagcctgcaggaccatgctggggcctgaactcccagcctaggtcctgggggccatgcctgtttctggacttcctgaccgggtcctgggggccaagctggcatctgaacccttagactgggtcctggatgggtggggggcggggtggggtatgttaggatccaagactcctgatcgcgtcccgggcaagagctagagtgggcttaacattcccgttttaccttttcagggagtctgggacatgctaaatcctaagggggctgacttggtgctaaggtccctggggggtggggaccaagccgaccctccctaggggagggagggtaaagcccgggtccgagttagaggggccaagccacaggctactgtaaacacggtttgtgtgagggcgccagatcacttgcccggcccggtggagggagggaggcggggggcacggttggcgctatcggttggcggggagcctgccggggccgatagggggcccgcctctccgcacacacccccagccgcgcgcgtgtcctaggctggggcggggctggcagtcccgagctcgaggtcttgaacgccgcgcccagctcagctggccgctgggtgggcaggtgtgcgccagtggtgacggcgggggacagtaaggcgagaaacttgcccctgggaattaggggggcaccacctctgcggacccctccaagggacccgcttgggaagatggcagggcggggcttttttcttatcgggtccgcccaggctgcgggagggaagaggagggggctgtctcccgaggatagagctcagacccccatgcccttcctttgtcgcccctccccagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagaggggcaccgttttcctttcccctgattggctcagttccaccagggcccgcccccacgtcatctatttttgtctgctacgcgtccctcgccctgattccgcccccaggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcagccatgttctaa

SEQ ID NO: 736725 - DNA, 592 bp, Homo sapiens; identical to SEQ ID NO: 92303

SEQ ID NO: 736726 - DNA, 6881 bp, Homo sapiens
  misc_feature (1255)..(1255): n is a, c, g, or t
gcggccgccgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggaaaaggccaaagttgttgagcccctggactatgagaatgttattgcccaaagaaaaacccagatttacagcgaccccctccgagatctgcttatgttcccaatggaagatatatctatctcggtgataggtcgtcaacgcagaacggtgcagtctactgtaccagaagatgctgaaaagagggcccagagtttatttgttaaagagtgtattaaaacctatagcacagattggcacgtggtaaactacaagtatgaggacttctctggggactttcgaatgttgccatgtaaatctttgagaccagaaaagattcctaatcatgtatttgagatagatgaagactgtgagaaagatgaggactcatcttctttatgttctcagaagggtggtgtgataaaacaaggctggttgcataaagcaaatgtaaatagtaccatcacagtaaccatgaaggtattcaagagacgatatttttacttgacccaacttcctgacggttcatatattctcaattcctataaagatgagaaaaattcaaaagaatcgaaaggttgcatctacttggacgcctgcattgatgttgttcagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaagatgatgaaactagcagccaaggaaaagccgagaacatcatggcaagtttggaaaggagcatgcatccggaactgatgaagtatggaagagaaactgaacaactaaacaaactcagtagaggagatggaagacagaatctcttttcttttgattcagaagttcagaggttggacttttcaggaattgaacctgatataaagccatttgaagaaaaatgcaataaacgtttcctggtgaattgccatgatttaactttcaatatcttgggccaaattggagacaatgcaaaaggaccacccacnaatgttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacagggaattttctcagtgacgaatccacatcctgaaatttttctagttgccagaattgaaaaggtactacagggaaacattacacactgtgcagaaccctatatcaaaaattctgatccagtaaagacggcccagaaggtgcacaggacagctaaacaagtgtgtagccgccttggacaatacagaatgcccttcgcttgggctgccagacccattttcaaagatactcaaggctctcttgatctggatgggagattttctcctctgtataaacaagacagtagcaagctttcaagtgaagacattctcaagttgctctcagaatataagaagccagaaaagaccaaactgcagattattcctgggcagctaaacatcacagtagaatgtgttcctgtggatttatcaactgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggcaaggaacattgcagtctgtgtggaattccgggattcagatgaaagtgacgctagtgccctaaagtgtatttatggaaaacctgcagggtctgtttttaccacaaatgcttatgctgttgtctcgcatcacaaccaaaatccagagttctatgatgagattaaaattgagcttcccattcacctacatcaaaaacatcatttgcttttcactttttatcatgtaagttgtgaaattaacacaaagggaacaaccaaaaagcaagacacagttgaaactccagttgggtttgcctgggtacctttgctgaaagatggtagaatcatcacatttgagcagcagctgccagtttccgccaatcttcccccaggctacttgaatctgaatgatcaatgtaacgtggatattaaatgggtagatggtgcaaagcctttgttgaagattaaaagccacttagaatctaccatttacactcaagatctgcatgtgcacaaattcttccatcattgccagctgattcagtcaggctcgaaagaagttccaggggagctcattaaatatttaaagtgtttgcatgccatggagatccaagtcatgatacagtttctacctgtaattcttatgcaactcttccgagttctcacaaatatgacccatgaagatgacgttcctatcaactgcaccatggttctcttacatattgtatcaaagtgccatgaagaaggcttggatagttatctaagatcattcataaagtatagcttccgacctgaaaaaccgagtgctcctcaggcccagctgatacatgaaaccctggctactacgatgatagcaatattgaaacagtctgcagattttttatcaataaacaaattgctaaagtactcatggtttttctttgaaataattgcaaagtcaatggccacatacttgttggaagagaataagattaagcttccccgaggccagagatttcccgagacatatcatcatgtcttacattcactgcttcttgcaataattccccatgtgactattcggtatgcggagattcccgatgagtccagaaatgtgaactatagtttggctagcttcctgaagcgctgtttgacactaatggatagaggatttattttcaatttaataaatgactatatatctggattcagccccaaagatcctaaggttctggctgaatacaagtttgaatttctgcaaacaatttgcaatcacgaacattacattcctctgaacttgccaatggcatttgcaaaacctaaactgcagcgggttcaagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaagaaccaacaagccaaaatagcacaattgtacctcccctttgttggactacttttggaaaatatacagcgattagcaggtcgagataccttgtattcttgtgcagccatgcctaattctgcatccagagatgagtttccatgtggctttacttcacctgccaatagagggagtctgagcactgacaaagacaccgcttatgggtcttttcaaaatggacatggaattaagagagaagattcaagaggttccctcatcccagaaggagcaacaggatttccagatcagggcaacactggtgaaaatacccgacagagttctacaaggagtagtgtatcccagtataaccgcctggatcagtatgaaatcagaagcctcctgatgtgctacctgtatatagtaaaaatgatttcagaagatactctcttaacttactggaataaagtatcacctcaggagctcataaacattcttatacttttagaagtatgcttgtttcactttagatatatggggaaaagaaacatagcaagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagttctacaacaactgaagcagacattttccaccaggcacttcttgaaggcaatacagctactgaagtttccctaacagtactagacaccatatcatttttcactcagtgcttcaagacccaacttttaaataatgatggccataacccattaatgaaaaaagtgtttgatatacatcttgcttttcttaaaaatggacaatctgaagtgtcgctgaaacatgtatttgcctcactgagagctttcatcagtaagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacagataataattgctgtaagccaactgatagctgatgtagcactaagcggaggatcaagatttcaggagtctttattcattatcaataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaattagaagtgaaagaaataatactttgaacttagcatttttcttgacaagaagctcaattcattatcatactaatccttggtaggaggagaagaaaattgataacatttccgtaatacacggatatttaaaattggggagatcatttgaatccttgccaattagtagtcaaggctgggctaaaggaaccaaaagcattatttcacagaaaatttcaaaaggaaaggatatat

SEQ ID NO: 736727 - DNA, 6692 bp, Homo sapiens
  misc_feature (1255)..(1255): n is a, c, g, or t
gcggccgccgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggaaaaggccaaagttgttgagcccctggactatgagaatgttattgcccaaagaaaaacccagatttacagcgaccccctccgagatctgcttatgttcccaatggaagatatatctatctcggtgataggtcgtcaacgcagaacggtgcagtctactgtaccagaagatgctgaaaagagggcccagagtttatttgttaaagagtgtattaaaacctatagcacagattggcacgtggtaaactacaagtatgaggacttctctggggactttcgaatgttgccatgtaaatctttgagaccagaaaagattcctaatcatgtatttgagatagatgaagactgtgagaaagatgaggactcatcttctttatgttctcagaagggtggtgtgataaaacaaggctggttgcataaagcaaatgtaaatagtaccatcacagtaaccatgaaggtattcaagagacgatatttttacttgacccaacttcctgacggttcatatattctcaattcctataaagatgagaaaaattcaaaagaatcgaaaggttgcatctacttggacgcctgcattgatgttgttcagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaagatgatgaaactagcagccaaggaaaagccgagaacatcatggcaagtttggaaaggagcatgcatccggaactgatgaagtatggaagagaaactgaacaactaaacaaactcagtagaggagatggaagacagaatctcttttcttttgattcagaagttcagaggttggacttttcaggaattgaacctgatataaagccatttgaagaaaaatgcaataaacgtttcctggtgaattgccatgatttaactttcaatatcttgggccaaattggagacaatgcaaaaggaccacccacnaatgttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacagggaattttctcagtgacgaatccacatcctgaaatttttctagttgccagaattgaaaaggtactacagggaaacattacacactgtgcagaaccctatatcaaaaattctgatccagtaaagacggcccagaaggtgcacaggacagctaaacaagtgtgtagccgccttggacaatacagaatgcccttcgcttgggctgccagacccattttcaaagatactcaaggctctcttgatctggatgggagattttctcctctgtataaacaagacagtagcaagctttcaagtgaagacattctcaagttgctctcagaatataagaagccagaaaagaccaaactgcagattattcctgggcagctaaacatcacagtagaatgtgttcctgtggatttatcaactgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggcaaggaacattgcagtctgtgtggaattccgggattcagatgaaagtgacgctagtgccctaaagtgtatttatggaaaacctgcagggtctgtttttaccacaaatgcttatgctgttgtctcgcatcacaaccaaaatccagagttctatgatgagattaaaattgagcttcccattcacctacatcaaaaacatcatttgcttttcactttttatcatgtaagttgtgaaattaacacaaagggaacaaccaaaaagcaagacacagttgaaactccagttgggtttgcctgggtacctttgctgaaagatggtagaatcatcacatttgagcagcagctgccagtttccgccaatcttcccccaggctacttgaatctgaatgatcaatgtaacgtggatattaaatgggtagatggtgcaaagcctttgttgaagattaaaagccacttagaatctaccatttacactcaagatctgcatgtgcacaaattcttccatcattgccagctgattcagtcaggctcgaaagaagttccaggggagctcattaaatatttaaagtgtttgcatgccatggagatccaagtcatgatacagtttctacctgtaattcttatgcaactcttccgagttctcacaaatatgacccatgaagatgacgttcctatcaactgcaccatggttctcttacatattgtatcaaagtgccatgaagaaggcttggatagttatctaagatcattcataaagtatagcttccgacctgaaaaaccgagtgctcctcaggcccagctgatacatgaaaccctggctactacgatgatagcaatattgaaacagtctgcagattttttatcaataaacaaattgctaaagtactcatggtttttctttgaaataattgcaaagtcaatggccacatacttgttggaagagaataagattaagcttccccgaggccagagatttcccgagacatatcatcatgtcttacattcactgcttcttgcaataattccccatgtgactattcggtatgcggagattcccgatgagtccagaaatgtgaactatagtttggctagcttcctgaagcgctgtttgacactaatggatagaggatttattttcaatttaataaatgactatatatctggattcagccccaaagatcctaaggttctggctgaatacaagtttgaatttctgcaaacaatttgcaatcacgaacattacattcctctgaacttgccaatggcatttgcaaaacctaaactgcagcgggttcaagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaagaaccaacaagccaaaatagcacaattgtacctcccctttgttggactacttttggaaaatatacagcgattagcaggtcgagataccttgtattcttgtgcagccatgcctaattctgcatccagagatgagtttccatgtggctttacttcacctgccaatagagggagtctgagcactgacaaagacaccgcttatgggtcttttcaaaatggacatggaattaagagagaagattcaagaggttccctcatcccagaaggagcaacaggatttccagatcagggcaacactggtgaaaatacccgacagagttctacaaggagtagtgtatcccagtataaccgcctggatcagtatgaaatcagaagcctcctgatgtgctacctgtatatagtaaaaatgatttcagaagatactctcttaacttactggaataaagtatcacctcaggagctcataaacattcttatacttttagaagtatgcttgtttcactttagatatatggggaaaagaaacatagcaagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagttctacaacaactgaagcagacattttccaccaggcacttcttgaaggcaatacagctactgaagtttccctaacagtactagacaccatatcatttttcactcagtgcttcaagacccaacttttaaataatgatggccataacccattaatgaaaaaagtgtttgatatacatcttgcttttcttaaaaatggacaatctgaagtgtcgctgaaacatgtatttgcctcactgagagctttcatcagtaagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacagataataattgctgtaagccaactgatagctgatgtagcactaagcggaggatcaagatttcaggagtctttattcattatcaataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaattagaagtgaaagaaaaaaaaaaagtcgacgcggccgcgaat

SEQ ID NO: 736728 - DNA, 6896 bp, Homo sapiens
  misc_feature (1255)..(1255): n is a, c, g, or t
gcggccgccgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggaaaaggccaaagttgttgagcccctggactatgagaatgttattgcccaaagaaaaacccagatttacagcgaccccctccgagatctgcttatgttcccaatggaagatatatctatctcggtgataggtcgtcaacgcagaacggtgcagtctactgtaccagaagatgctgaaaagagggcccagagtttatttgttaaagagtgtattaaaacctatagcacagattggcacgtggtaaactacaagtatgaggacttctctggggactttcgaatgttgccatgtaaatctttgagaccagaaaagattcctaatcatgtatttgagatagatgaagactgtgagaaagatgaggactcatcttctttatgttctcagaagggtggtgtgataaaacaaggctggttgcataaagcaaatgtaaatagtaccatcacagtaaccatgaaggtattcaagagacgatatttttacttgacccaacttcctgacggttcatatattctcaattcctataaagatgagaaaaattcaaaagaatcgaaaggttgcatctacttggacgcctgcattgatgttgttcagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaagatgatgaaactagcagccaaggaaaagccgagaacatcatggcaagtttggaaaggagcatgcatccggaactgatgaagtatggaagagaaactgaacaactaaacaaactcagtagaggagatggaagacagaatctcttttcttttgattcagaagttcagaggttggacttttcaggaattgaacctgatataaagccatttgaagaaaaatgcaataaacgtttcctggtgaattgccatgatttaactttcaatatcttgggccaaattggagacaatgcaaaaggaccacccacnaatgttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacagggaattttctcagtgacgaatccacatcctgaaatttttctagttgccagaattgaaaaggtactacagggaaacattacacactgtgcagaaccctatatcaaaaattctgatccagtaaagacggcccagaaggtgcacaggacagctaaacaagtgtgtagccgccttggacaatacagaatgcccttcgcttgggctgccagacccattttcaaagatactcaaggctctcttgatctggatgggagattttctcctctgtataaacaagacagtagcaagctttcaagtgaagacattctcaagttgctctcagaatataagaagccagaaaagaccaaactgcagattattcctgggcagctaaacatcacagtagaatgtgttcctgtggatttatcaactgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggcaaggaacattgcagtctgtgtggaattccgggattcagatgaaagtgacgctagtgccctaaagtgtatttatggaaaacctgcagggtctgtttttaccacaaatgcttatgctgttgtctcgcatcacaaccaaaatccagagttctatgatgagattaaaattgagcttcccattcacctacatcaaaaacatcatttgcttttcactttttatcatgtaagttgtgaaattaacacaaagggaacaaccaaaaagcaagacacagttgaaactccagttgggtttgcctgggtacctttgctgaaagatggtagaatcatcacatttgagcagcagctgccagtttccgccaatcttcccccaggctacttgaatctgaatgatcaatgtaacgtggatattaaatgggtagatggtgcaaagcctttgttgaagattaaaagccacttagaatctaccatttacactcaagatctgcatgtgcacaaattcttccatcattgccagctgattcagtcaggctcgaaagaagttccaggggagctcattaaatatttaaagtgtttgcatgccatggagatccaagtcatgatacagtttctacctgtaattcttatgcaactcttccgagttctcacaaatatgacccatgaagatgacgttcctatcaactgcaccatggttctcttacatattgtatcaaagtgccatgaagaaggcttggatagttatctaagatcattcataaagtatagcttccgacctgaaaaaccgagtgctcctcaggcccagctgatacatgaaaccctggctactacgatgatagcaatattgaaacagtctgcagattttttatcaataaacaaattgctaaagtactcatggtttttctttgaaataattgcaaagtcaatggccacatacttgttggaagagaataagattaagcttccccgaggccagagatttcccgagacatatcatcatgtcttacattcactgcttcttgcaataattccccatgtgactattcggtatgcggagattcccgatgagtccagaaatgtgaactatagtttggctagcttcctgaagcgctgtttgacactaatggatagaggatttattttcaatttaataaatgactatatatctggattcagccccaaagatcctaaggttctggctgaatacaagtttgaatttctgcaaacaatttgcaatcacgaacattacattcctctgaacttgccaatggcatttgcaaaacctaaactgcagcgggttcaagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaagaaccaacaagccaaaatagcacaattgtacctcccctttgttggactacttttggaaaatatacagcgattagcaggtcgagataccttgtattcttgtgcagccatgcctaattctcttatgggtcttttcaaaatggacatggaattaagagagaagattcaagaggttccctcatcccagaaggagcaacaggatttccagatcagggcaacactggtgaaaatccatgattattttaaaattttaccactaaaacacatggcatatgagaatgaaacacagtattcatggctatatctttgtgaagactccaagacccgacagagttctacaaggagtagtgtatcccagtataaccgcctggatcagtatgaaatcagaagcctcctgatgtgctacctgtatatagtaaaaatgatttcagaagatactctcttaacttactggaataaagtatcacctcaggagctcataaacattcttatacttttagaagtatgcttgtttcactttagatatatggggaaaagaaacatagcaagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagttctacaacaactgaagcagacattttccaccaggcacttcttgaaggcaatacagctactgaagtttccctaacagtactagacaccatatcatttttcactcagtgcttcaagacccaacttttaaataatgatggccataacccattaatgaaaaaagtgtttgatatacatcttgcttttcttaaaaatggacaatctgaagtgtcgctgaaacatgtatttgcctcactgagagctttcatcagtaagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacagataataattgctgtaagccaactgatagctgatgtagcactaagcggaggatcaagatttcaggagtctttattcattatcaataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaattagaagtgaaagaaataatactttgaacttagcatttttcttgacaagaagctcaattcattatcatactaatccttggtaggaggagaagaaaattgataacatttccgtaatacacggatatttaaaattggggagatcatttgaatccttgccaattagtagtcaaggctgggctaaaggaaccaaaagcattatttcacagaaaatttcaaaaggaaaggatatat

SEQ ID NO: 736729 - DNA, 6782 bp, Homo sapiens
  misc_feature (1255)..(1255): n is a, c, g, or t
gcggccgccgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggaaaaggccaaagttgttgagcccctggactatgagaatgttattgcccaaagaaaaacccagatttacagcgaccccctccgagatctgcttatgttcccaatggaagatatatctatctcggtgataggtcgtcaacgcagaacggtgcagtctactgtaccagaagatgctgaaaagagggcccagagtttatttgttaaagagtgtattaaaacctatagcacagattggcacgtggtaaactacaagtatgaggacttctctggggactttcgaatgttgccatgtaaatctttgagaccagaaaagattcctaatcatgtatttgagatagatgaagactgtgagaaagatgaggactcatcttctttatgttctcagaagggtggtgtgataaaacaaggctggttgcataaagcaaatgtaaatagtaccatcacagtaaccatgaaggtattcaagagacgatatttttacttgacccaacttcctgacggttcatatattctcaattcctataaagatgagaaaaattcaaaagaatcgaaaggttgcatctacttggacgcctgcattgatgttgttcagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaagatgatgaaactagcagccaaggaaaagccgagaacatcatggcaagtttggaaaggagcatgcatccggaactgatgaagtatggaagagaaactgaacaactaaacaaactcagtagaggagatggaagacagaatctcttttcttttgattcagaagttcagaggttggacttttcaggaattgaacctgatataaagccatttgaagaaaaatgcaataaacgtttcctggtgaattgccatgatttaactttcaatatcttgggccaaattggagacaatgcaaaaggaccacccacnaatgttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacagggaattttctcagtgacgaatccacatcctgaaatttttctagttgccagaattgaaaaggtactacagggaaacattacacactgtgcagaaccctatatcaaaaattctgatccagtaaagacggcccagaaggtgcacaggacagctaaacaagtgtgtagccgccttggacaatacagaatgcccttcgcttgggctgccagacccattttcaaagatactcaaggctctcttgatctggatgggagattttctcctctgtataaacaagacagtagcaagctttcaagtgaagacattctcaagttgctctcagaatataagaagccagaaaagaccaaactgcagattattcctgggcagctaaacatcacagtagaatgtgttcctgtggatttatcaactgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggcaaggaacattgcagtctgtgtggaattccgggattcagatgaaagtgacgctagtgccctaaagtgtatttatggaaaacctgcagggtctgtttttaccacaaatgcttatgctgttgtctcgcatcacaaccaaaatccagagttctatgatgagattaaaattgagcttcccattcacctacatcaaaaacatcatttgcttttcactttttatcatgtaagttgtgaaattaacacaaagggaacaaccaaaaagcaagacacagttgaaactccagttgggtttgcctgggtacctttgctgaaagatggtagaatcatcacatttgagcagcagctgccagtttccgccaatcttcccccaggctacttgaatctgaatgatcaatgtaacgtggatattaaatgggtagatggtgcaaagcctttgttgaagattaaaagccacttagaatctaccatttacactcaagatctgcatgtgcacaaattcttccatcattgccagctgattcagtcaggctcgaaagaagttccaggggagctcattaaatatttaaagtgtttgcatgccatggagatccaagtcatgatacagtttctacctgtaattcttatgcaactcttccgagttctcacaaatatgacccatgaagatgacgttcctatcaactgcaccatggttctcttacatattgtatcaaagtgccatgaagaaggcttggatagttatctaagatcattcataaagtatagcttccgacctgaaaaaccgagtgctcctcaggcccagctgatacatgaaaccctggctactacgatgatagcaatattgaaacagtctgcagattttttatcaataaacaaattgctaaagtactcatggtttttctttgaaataattgcaaagtcaatggccacatacttgttggaagagaataagattaagcttccccgaggccagagatttcccgagacatatcatcatgtcttacattcactgcttcttgcaataattccccatgtgactattcggtatgcggagattcccgatgagtccagaaatgtgaactatagtttggctagcttcctgaagcgctgtttgacactaatggatagaggatttattttcaatttaataaatgactatatatctggattcagccccaaagatcctaaggttctggctgaatacaagtttgaatttctgcaaacaatttgcaatcacgaacattacattcctctgaacttgccaatggcatttgcaaaacctaaactgcagcgggttcaagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaagaaccaacaagccaaaatagcacaattgtacctcccctttgttggactacttttggaaaatatacagcgattagcaggtcgagataccttgtattcttgtgcagccatgcctaattctcttatgggtcttttcaaaatggacatggaattaagagagaagattcaagaggttccctcatcccagaaggagcaacaggatttccagatcagggcaacactggtgaaaatccatgattattttaaaattttaccactaaaacacatggcatatgagaatgaaacacagtattcatggctatatctttgtgaagactccaagacccgacagagttctacaaggagtagtgtatcccagtataaccgcctggatcagtatgaaatcagaagcctcctgatgtgctacctgtatatagtaaaaatgatttcagaagatactctcttaacttactggaataaagtatcacctcaggagctcataaacattcttatacttttagaagtatgcttgtttcactttagatatatggggaaaagaaacatagcaagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagttctacaacaactgaagcagacattttccaccaggcacttcttgaaggcaatacagctactgaagtttccctaacagtactagacaccatatcatttttcactcagtgcttcaagacccaacttttaaataatgatggccataacccattaatgaaaaaagtgtttgatatacatcttgcttttcttaaaaatggacaatctgaagtgtcgctgaaacatgtatttgcctcactgagagctttcatcagtaagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacagataataattgctgtaagccaactgatagctgatgtagcactaagcggaggatcaagatttcaggagtctttattcattatcaataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagtctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaattagaagtgaaagaaataatactttgaacttagcatttttcttgacaagaagctcaattcattatcatactaatccttggtaggaggagaagaaaattgataacatttccgtaatacacggatatttaaaattggggagatcatttgaatccttgccaattagtagtcaaggctgggctaaaggaaccaaaagcattatttcacagaaaatttcaaaaggaaaggatatat

SEQ ID NO: 736730 - DNA, 6829 bp, Homo sapiens
  misc_feature (1203)..(1203): n is a, c, g, or t
gcggccgccgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggaaaaggccaaagttgttgagcccctggactatgagaatgttattgcccaaagaaaaacccagatatctcggtgataggtcgtcaacgcagaacggtgcagtctactgtaccagaagatgctgaaaagagggcccagagtttatttgttaaagagtgtattaaaacctatagcacagattggcacgtggtaaactacaagtatgaggacttctctggggactttcgaatgttgccatgtaaatctttgagaccagaaaagattcctaatcatgtatttgagatagatgaagactgtgagaaagatgaggactcatcttctttatgttctcagaagggtggtgtgataaaacaaggctggttgcataaagcaaatgtaaatagtaccatcacagtaaccatgaaggtattcaagagacgatatttttacttgacccaacttcctgacggttcatatattctcaattcctataaagatgagaaaaattcaaaagaatcgaaaggttgcatctacttggacgcctgcattgatgttgttcagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaagatgatgaaactagcagccaaggaaaagccgagaacatcatggcaagtttggaaaggagcatgcatccggaactgatgaagtatggaagagaaactgaacaactaaacaaactcagtagaggagatggaagacagaatctcttttcttttgattcagaagttcagaggttggacttttcaggaattgaacctgatataaagccatttgaagaaaaatgcaataaacgtttcctggtgaattgccatgatttaactttcaatatcttgggccaaattggagacaatgcaaaaggaccacccacnaatgttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacagggaattttctcagtgacgaatccacatcctgaaatttttctagttgccagaattgaaaaggtactacagggaaacattacacactgtgcagaaccctatatcaaaaattctgatccagtaaagacggcccagaaggtgcacaggacagctaaacaagtgtgtagccgccttggacaatacagaatgcccttcgcttgggctgccagacccattttcaaagatactcaaggctctcttgatctggatgggagattttctcctctgtataaacaagacagtagcaagctttcaagtgaagacattctcaagttgctctcagaatataagaagccagaaaagaccaaactgcagattattcctgggcagctaaacatcacagtagaatgtgttcctgtggatttatcaactgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggcaaggaacattgcagtctgtgtggaattccgggattcagatgaaagtgacgctagtgccctaaagtgtatttatggaaaacctgcagggtctgtttttaccacaaatgcttatgctgttgtctcgcatcacaaccaaaatccagagttctatgatgagattaaaattgagcttcccattcacctacatcaaaaacatcatttgcttttcactttttatcatgtaagttgtgaaattaacacaaagggaacaaccaaaaagcaagacacagttgaaactccagttgggtttgcctgggtacctttgctgaaagatggtagaatcatcacatttgagcagcagctgccagtttccgccaatcttcccccaggctacttgaatctgaatgatcaatgtaacgtggatattaaatgggtagatggtgcaaagcctttgttgaagattaaaagccacttagaatctaccatttacactcaagatctgcatgtgcacaaattcttccatcattgccagctgattcagtcaggctcgaaagaagttccaggggagctcattaaatatttaaagtgtttgcatgccatggagatccaagtcatgatacagtttctacctgtaattcttatgcaactcttccgagttctcacaaatatgacccatgaagatgacgttcctatcaactgcaccatggttctcttacatattgtatcaaagtgccatgaagaaggcttggatagttatctaagatcattcataaagtatagcttccgacctgaaaaaccgagtgctcctcaggcccagctgatacatgaaaccctggctactacgatgatagcaatattgaaacagtctgcagattttttatcaataaacaaattgctaaagtactcatggtttttctttgaaataattgcaaagtcaatggccacatacttgttggaagagaataagattaagcttccccgaggccagagatttcccgagacatatcatcatgtcttacattcactgcttcttgcaataattccccatgtgactattcggtatgcggagattcccgatgagtccagaaatgtgaactatagtttggctagcttcctgaagcgctgtttgacactaatggatagaggatttattttcaatttaataaatgactatatatctggattcagccccaaagatcctaaggttctggctgaatacaagtttgaatttctgcaaacaatttgcaatcacgaacattacattcctctgaacttgccaatggcatttgcaaaacctaaactgcagcgggttcaagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaagaaccaacaagccaaaatagcacaattgtacctcccctttgttggactacttttggaaaatatacagcgattagcaggtcgagataccttgtattcttgtgcagccatgcctaattctgcatccagagatgagtttccatgtggctttacttcacctgccaatagagggagtctgagcactgacaaagacaccgcttatgggtcttttcaaaatggacatggaattaagagagaagattcaagaggttccctcatcccagaaggagcaacaggatttccagatcagggcaacactggtgaaaatacccgacagagttctacaaggagtagtgtatcccagtataaccgcctggatcagtatgaaatcagaagcctcctgatgtgctacctgtatatagtaaaaatgatttcagaagatactctcttaacttactggaataaagtatcacctcaggagctcataaacattcttatacttttagaagtatgcttgtttcactttagatatatggggaaaagaaacatagcaagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagttctacaacaactgaagcagacattttccaccaggcacttcttgaaggcaatacagctactgaagtttccctaacagtactagacaccatatcatttttcactcagtgcttcaagacccaacttttaaataatgatggccataacccattaatgaaaaaagtgtttgatatacatcttgcttttcttaaaaatggacaatctgaagtgtcgctgaaacatgtatttgcctcactgagagctttcatcagtaagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacagataataattgctgtaagccaactgatagctgatgtagcactaagcggaggatcaagatttcaggagtctttattcattatcaataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaattagaagtgaaagaaataatactttgaacttagcatttttcttgacaagaagctcaattcattatcatactaatccttggtaggaggagaagaaaattgataacatttccgtaatacacggatatttaaaattggggagatcatttgaatccttgccaattagtagtcaaggctgggctaaaggaaccaaaagcattatttcacagaaaatttcaaaaggaaaggatatat

SEQ ID NO: 736731 - DNA, 780 bp, Homo sapiens; identical to SEQ ID NO: 36153

SEQ ID NO: 736732 - DNA, 522 bp, Homo sapiens; identical to SEQ ID NO: 36154

SEQ ID NO: 736733 - DNA, 755 bp, Homo sapiens
ctgtcctgattagaattaattttcataaagagaacaagaatcttgactggttcacccttcaattccttgtgcccgcaacagtgaccggcacatggaaagcattcagggaataaaagcacaatggaaaattaaaacatactcactgcatgcctgccacctatagaaccaaattaaatcactgccaatatgcatggggaaaaccttcccatttttctggaataatgttacaaaggatggaaaataagtgcacatcacctggatggcatttaataaacgctgtgacccagtagtgtacatttcagtgaatattgccaaaggaagtaggccaacatcaggtaatctgagttaactttcctgtacattgtgtattcgtttcctgatgatcaaaactggattaattagtctacaatgtatctttcctgttagatacgaagattatctgctctatccaatttgtgttttcttagctgagaaatcactgttgaattttaaaagcagcttgcctggtcctcatttcctggtcttctgatggaaatggtttatggaaaaaaaaatatttactagagtcagataattagaacattttatgtattttgcatatgctaatgcgtttgagttcctttgagggagagccgcatggcataaagcagaatgaaaaggatgattcaaatttcttcacccagcctcctcccctggccagatttagcacttcctatataccaccacctcacagcttagcttggctgggagctcct

SEQ ID NO: 736734 - DNA, 692 bp, Homo sapiens
tggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgcc

SEQ ID NO: 736735 - DNA, 368 bp, Homo sapiens; identical to SEQ ID NO: 117527

SEQ ID NO: 736736 - DNA, 634 bp, Homo sapiens
agcactagaattgctgagcatctgggcgatagccagagcttgggtagaatgctggccgattatcgagccagaggaggaagaattcagcccaaaaattcagacccttttgctcattcaaaggatgcatcaagtacttcaagtggcaaatcaggaagcaaaaacgagggtgatgaagagagagggcttattctgagtgatgctgtgtggtcaacaaaggtggactgtctgaatcccattaatcaccagagactttgtgtgctcttcagcagctcttctgcccagtccagcaatgctcctagtgcctgtgtcagtccttggattgtaacaatggaattttatggaaagaatgatcttacattaggaatatttttagagagatactgtttcaggccttcttatcagtgtccaagcatgttctgtgatacccccatggtacatcatattcggcgctttgttcatggccaaggctgtgtgcagataatcctgaaggagttggattctccagtacctggatatcagcatacaattcttacatattcctggtgtagaatctgcaaacaggtaacaccagttgttgctctttccaatgagtcctggtctatgtcatttgcaaaataccttgaacttaggtttt

SEQ ID NO: 736737 - DNA, 909 bp, Homo sapiens; identical to SEQ ID NO: 117529

SEQ ID NO: 736738 - DNA, 2479 bp, Homo sapiens
gtggctcgctggacaaagctggccgtgcaggcgctcaggcgtgcagggtagccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggagcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcaccttggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgagtagagatgtcattgccctggtgagccaggtcttgccggtttatagtgtctttcacgtgtttgaggccatctgtgtctatcctggagaatgctgcatgtgagacccaaggaatgtcattgtgttggttaagtaacttgcttagactgattctgtgactcctgtctcctctacaatgtacagctgctgatgtctcttgctcagttttttcccccttgttcttatttttttaagtctagctttctagtttaaaatgttctttctaggattaaaaatgtctgcagagcttagtgttcagccaattactggtcagagactgtgttcaacacctctgatagctagcaaagcttccattctctgctgacagatccatgtgtgggctagagacgtattcagagttccagctgttttcaatgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagactggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctgggcacagcctgctgctcaagtctgtcata

SEQ ID NO: 736739 - DNA, 924 bp, Homo sapiens
gtggctcgctggacaaagctggccgtgcaggcgctcaggcgtgcagggtagccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggccgtgagtacccagcttggcccagagcagggacgttctctccccaggcttctccaccgggttcccgggtgggcccgtcttgggtggctggtcagggatgggaagacacagcccacgtggctggacagctgccttcacaggtggaacctgagggccggagatggaggcggtctggccctggggcacacagcacatgaggctgctgagcagagcctctgccaccgctgcctgctgggcagcatttcctgaccctggctcagcccagatgcaggggcctctcttcaggcctcacctgacaagctcttgtttcctcctgtgtgtggcgccagtttgtcaatgtctgcggagtttctgtaggagttggtttgtcttcggcatgtgacaccttgatgtctcaggtgggtggcctcctggagctgggcaggaagccaggcaagggcagagccaattccacaggtgccatggagatggcaggtgggaggggcgcagccaggtgatctgggagcaatgggccctggggtcagctgcccctgccctacctccaaggaccacaggctgtcagggaaacagaccctcccctttgaaagagtctgggccaggagaaaggggtggagatggtggagacagttctct

SEQ ID NO: 736740 - DNA, 2492 bp, Homo sapiens
agaaaatgtaggaatgcattggcttctatcacaaaaatcctgggaatgttcctgagaagggattttggagatgctcggcctaggactggccctcgggaagatgacccgacctttgtcctgtgcagctgagtgctgaacactggtcagctctggataaagcctgatgtcaccgagctgatggcggggcgtctgcactgaacaccttccagcttggtgggggcacgggaaccagctgtcctcattaaaagtgacctggagtgagatggattcttctgcctatacctccacgtgtgggctccctgaacacccccatcgccatgggctcccaagaagtattgcttctggctgcagggctcactgcaatgctgcgacaggaggtgacaggccaaggccagcaggtgactgctctccccagaggccctgtcagctggaagcagctggtttcacataacagagaccccaggcccaggtcccctggatgcaggaggatttgcggctgcccttttggaagagttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggagcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcaccttggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgagtagagatgtcattgccctggtgagccaggtcttgccggtttatagtgtctttcacgtgtttgaggccatctgttgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctgggcacagcctgctgctcaagtctgtcata

SEQ ID NO: 736741 - DNA, 2171 bp, Homo sapiens
gtggctcgctggacaaagctggccgtgcaggcgctcaggcgtgcagggtagccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggagcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcaccttggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgagtagagatgtcattgccctggtgagccaggtcttgccggtttatagtgtctttcacgtgtttgaggccatctgttgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctgggcacagcctgctgctcaagtctgtcata

SEQ ID NO: 736742 - DNA, 2279 bp, Homo sapiens
gtggctcgctggacaaagctggccgtgcaggcgctcaggcgtgcagggtagccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggagcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagggatggctgaaggggcaggaggaggagtccccattccaaaccccgggtttgtccatcctccatccatctcactcacaccttagcagggccagttttcatttatttcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcaccttggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgagtagagatgtcattgccctggtgagccaggtcttgccggtttatagtgtctttcacgtgtttgaggccatctgttgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctgggcacagcctgctgctcaagtctgtcata

SEQ ID NO: 736743 - DNA, 2137 bp, Homo sapiens
gctgtacgcccttcggatatcgggatccggcaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggagcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcaccttggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgagtagagatgtcattgccctggtgagccaggtcttgccggtttatagtgtctttcacgtgtttgaggccatctgttgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctgggcacagcctgctgctcaagtctgtcata

SEQ ID NO: 736744 - DNA, 1208 bp, Homo sapiens
aactgaagacagaaaaaggaaactagaggagcttcttaattctgttggtcaaaaggtatcagaactcaaagaaaaatttcagagcaggacttcagaagctgccaaacttgaggctgaagtaagcaaggcaccagaaacaatcaaagctgcagaagtcttaattaatcagcttgacagagaacataagagatggaatgcacaggttgtagagataacagaggaattagctactcttcctaaaagagctcaacttgctgctgcatttattacatatctttctgctgctcctgaatctctgagaaaaacctgtttggaagaatggaccaagtcagctggtcttgagaaatttgatctgaggagatttctttgtactgaaagtgagcagttaatttggaaaagtgaaggcctaccatcagatgacctttccatagaaaatgctcttgtaatattacagagtcgagtgtgcccatttcttatagatccttcttcccaagctacagagtggttaaaaacacatttgaaagactcacgtttagaagttatcaatcagcaggatagtaactttatcacagctcttgaattagcagtacgttttgggaaaacccttattatacaagagatggatggtgtagaacctgttctttatccattattgagacgagatctggttgctcaaggaccacgttatgtggtacaaataggtgacaaaattattgactacaatgaagaattccgcctctttttgtcaacaagaaacccaaatccttttattccaccggatgcagcttccattgttactgaggttaactttactacaacaagaagtggattacgagggcagcttttagctttaaccattcagcatgagaaacctgatttagaagaacagaaaacaaaactattacaacaggaagaagataagaaaatacagctagccaagctcgaagaatctcttctagagacacttgccacatctcaaggcaatatcttgggaaaataaggatttgattgagtctttgaatcagacaaaagcaagcagtgcacttattcaagagtcacttaaagaatcttacaaactccaaatttcccttgatcaagaacgggatgcctatctccccctggctgagagtgccagcaagatgtacttcattatttctgatttgtccaaaattaataacatgtaccgttttagtttggctgcttttctc

SEQ ID NO: 736745 - DNA, 1428 bp, Homo sapiens
  misc_feature (1027)..(1027): n is a, c, g, or t
  misc_feature (1059)..(1059): n is a, c, g, or t
  misc_feature (1083)..(1083): n is a, c, g, or t
  misc_feature (1095)..(1096): n is a, c, g, or t
  misc_feature (1393)..(1393): n is a, c, g, or t
aactgaagacagaaaaaggaaactagaggagcttcttaattctgttggtcaaaaggtatcagaactcaaagaaaaatttcagagcaggacttcagaagctgccaaacttgaggctgaagtaagcaaggcaccagaaacaatcaaagctgcagaagtcttaattaatcagcttgacagagaacataagagatggaatgcacaggttgtagagataacagaggaattagctactcttcctaaaagagctcaacttgctgctgcatttattacatatctttctgctgctcctgaatctctgagaaaaacctgtttggaagaatggaccaagtcagctggtcttgagaaatttgatctgaggagatttctttgtactgaaagtgagcagttaatttggaaaagtgaaggcctaccatcagatgacctttccatagaaaatgctcttgtaatattacagagtcgagtgtgcccatttcttatagatccttcttcccaagctacagagtggttaaaaacacatttgaaagactcacgtttagaagttatcaatcagcaggatagtaactttatcacagctcttgaattagcagtacgttttgggaaaacccttattatacaagagatggatggtgtagaacctgttctttatccattattgagacgagatctggttgctcaaggaccacgttatgtggtacaaataggtgacaaaattattgactacaatgaagaattccgcctctttttgtcaacaagaaacccaaatccttttattccaccggatgcagcttccattgttactgaggttaactttactacaacaagaagtggattacgagggcagcttttagctttaaccattcagcatgagaaacctgatttagaagaacagaaaacaaaactattacaacaggaagaagataagaaaatacagctagccaagctcgaagaatctcttctagagacacttgccacatctcaaggcaatatcttgggaaaataaggatttgattgagtctttgattagacntgatcatgaacggatgctatctcccctgctgnagtgcacgacacgtccgtcatatnctgattgtcaannatatacatgacccgttagttggctgctttttgacttttcacgagtctacaacaaccagatctgaaatctgacagggatccagcctattagtatttcacattgatatgaatttatgccgtgccattaagtgatagtatgtccttgcattgttaagatgctctgactcttagaaagatgggatcgttagggcggctgtggaaatgtcgaaggtccttaacacatacgagaagtccgctggatatagaataattggccggcacctaagatggttccaactttaaaccttgttagagcctnttggggcgttttaaatcaagtgggaaagtcctttt

SEQ ID NO: 736746 - DNA, 224 bp, Homo sapiens
tgatcgagctggtaccaggtcaggctcagaaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgggccctgagtccaggtgtgca

SEQ ID NO: 736747 - DNA, 628 bp, Homo sapiens
  misc_feature (515)..(516): n is a, c, g, or t
tgggcgtcagggggttgactggttctcaggagggcactgtcccagggagtttggtgggccgggatctagcactttctgggcccctgcactgccccgggctcatgccagcagtaaagtagggaccataggaattgcagatgggctcagctgcatccagctctaaagcgcaagacagcctttggtcccagactgtcaggatccagactgcaggtgtcatgtatgtggcctagggtattggcttgtttttaaaaccttcctgtcaattatgctgcatatagaaaagtacacaaatggtaaattttcataaaccgcacttacccaaccagcgccttggtcaagaaagagcacataactgccccccagaacccattattgtgcccccttccagtcatttgccctccccaagggtaaccactactttttatttaaatattttaaaaataagatgggaatctcactatgttgcccgagctggtctcgaactcctgggctcaaatgatcctcctgtaatcccnncactttgggaggccgaggtgggtgggtggatcacctgacgtagagagtccaaggcctgacaaacatggagaaatgtcatccctatttaaaaaaataaaaaaattagccaaga

SEQ ID NO: 736748 - DNA, 763 bp, Homo sapiens
  misc_feature (507)..(507): n is a, c, g, or t
  misc_feature (526)..(526): n is a, c, g, or t
  misc_feature (553)..(553): n is a, c, g, or t
  misc_feature (571)..(571): n is a, c, g, or t
  misc_feature (603)..(603): n is a, c, g, or t
  misc_feature (622)..(622): n is a, c, g, or t
  misc_feature (626)..(626): n is a, c, g, or t
  misc_feature (634)..(634): n is a, c, g, or t
  misc_feature (645)..(645): n is a, c, g, or t
  misc_feature (708)..(708): n is a, c, g, or t
ctcgtgccgaattcggcacgagccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtaaaaaaaaaaaaaaaaaaaaactcgagggggggcccggtacccaatncgccctatagtgagtcgtnttacaattcactggccgtcgttttaancgtcgtgactgggaaaancctggcgttacccaacttaatcgcctggcagnacatccccctttcgccagntggngtaatagngaagaggcccnaccgatcgccctcccaacagtgggcagcctgaatggggattggaaattgtaagcgtaatattnggtaaaatccggtaaatttgggtaatcagtcatttttaaccaataggcgaatcgg

SEQ ID NO: 736749 - DNA, 4608 bp, Homo sapiens
  misc_feature (4352)..(4352): n is a, c, g, or t
  misc_feature (4371)..(4371): n is a, c, g, or t
  misc_feature (4398)..(4398): n is a, c, g, or t
  misc_feature (4416)..(4416): n is a, c, g, or t
  misc_feature (4448)..(4448): n is a, c, g, or t
  misc_feature (4467)..(4467): n is a, c, g, or t
  misc_feature (4471)..(4471): n is a, c, g, or t
  misc_feature (4479)..(4479): n is a, c, g, or t
  misc_feature (4490)..(4490): n is a, c, g, or t
  misc_feature (4553)..(4553): n is a, c, g, or t
ggcgcgggggcggggggcgccgcgcggccggaactgcgggcggggggcttcccgggggcggggggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaagtcctgtcctgcagggtgggatcagccctgccaggtgggccgccttcctggagacccgtagatgccagggctggaagctttcatttgccgggacactcgggcccatgggattgcacagagctggagggaggggtgagataggggcagataggagctgcaggggtgcctggcgagcctctggttttcctctgctcctctgcctgtcctctcccaactcaaggttctagtgggaaggggtgcccccaggctctcatgttcctggcgtgagatgaaaggatccctgcggagggtttggttcttgagggctgggggtggacttgggaacaggctgtgtgtttgtcccagcgatggtgcctgcttagcttcccgtccccaccccccagccccttggccctctcctgtctgccctagggagaaggcaggtggacaagggcccatgaaaaaatacaggtgtctagactgccagggagaccctggcccccagtagtgtgtcctggggacttcctcagagcgagaaacctcccccaatgtcttcaagacttttctctccccccgcccaaccccgtctctccctcccttgccacccaaatgttagaaaaatagctgtgaacagagagcgcttttgtctgcaatggcagcaggatctggacggtcccctcccctaagttcccccctccccaccccacactctgacagcttgttccgtgttgcccccccacccagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtaaaaaaaaaaaaaaaaaaaaactcgagggggggcccggtacccaatncgccctatagtgagtcgtnttacaattcactggccgtcgttttaancgtcgtgactgggaaaancctggcgttacccaacttaatcgcctggcagnacatccccctttcgccagntggngtaatagngaagaggcccnaccgatcgccctcccaacagtgggcagcctgaatggggattggaaattgtaagcgtaatattnggtaaaatccggtaaatttgggtaatcagtcatttttaaccaataggcgaatcgg

SEQ ID NO: 736750 - DNA, 4151 bp, Homo sapiens
ggcgcgggggcggggggcgccgcgcggccggaactgcgggcggggggcttcccgggggcggggggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaagtcctgtcctgcagggtgggatcagccctgccaggtgggccgccttcctggagacccgtagatgccagggctggaagctttcatttgccgggacactcgggcccatgggattgcacagagctggagggaggggtgagataggggcagataggagctgcaggggtgcctggcgagcctctggttttcctctgctcctctgcctgtcctctcccaactcaaggttctagtgggaaggggtgcccccaggctctcatgttcctggcgtgagatgaaaggatccctgcggagggtttggttcttgagggctgggggtggacttgggaacaggctgtgtgtttgtcccagcgatggtgcctgcttagcttcccgtccccaccccccagccccttggccctctcctgtctgccctagggagaaggcaggtggacaagggcccatgaaaaaatacaggtgtctagactgccagggagaccctggcccccagtagtgtgtcctggggacttcctcagagcgagaaacctcccccaatgtcttcaagacttttctctccccccgcccaaccccgtctctccctcccttgccacccaaatgttagaaaaatagctgtgaacagagagcgcttttgtctgcaatggcagcaggatctggacggtcccctcccctaagttcccccctccccaccccacactctgacagcttgttccgtgttgcccccccacccagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggatatgagagtgcgcatgtgcacacgtgttcccaggcaggggtcagaagggcagcgtgtccatgaagatc

SEQ ID NO: 736751 - DNA, 4541 bp, Homo sapiens
  misc_feature (4285)..(4285): n is a, c, g, or t
  misc_feature (4304)..(4304): n is a, c, g, or t
  misc_feature (4331)..(4331): n is a, c, g, or t
  misc_feature (4349)..(4349): n is a, c, g, or t
  misc_feature (4381)..(4381): n is a, c, g, or t
  misc_feature (4400)..(4400): n is a, c, g, or t
  misc_feature (4404)..(4404): n is a, c, g, or t
  misc_feature (4412)..(4412): n is a, c, g, or t
  misc_feature (4423)..(4423): n is a, c, g, or t
  misc_feature (4486)..(4486): n is a, c, g, or t
ggcgcgggggcggggggcgccgcgcggccggaactgcgggcggggggcttcccgggggcggggggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaagtcctgtcctgcagggtgggatcagccctgccaggtgggccgccttcctggagacccgtagatgccagggctggaagctttcatttgccgggacactcgggcccatgggattgcacagagctggagggaggggtgagataggggcagataggagctgcaggggtgcctggcgagcctctggttttcctctgctcctctgcctgtcctctcccaactcaaggttctagtgggaaggggtgcccccaggctctcatgttcctggcgtgagatgaaaggatccctgcggagggtttggttcttgagggctgggggtggacttgggaacaggctgtgtgtttgtcccagcgatggtgcctgcttagcttcccgtccccaccccccagccccttggccctctcctgtctgccctagggagaaggcaggtggacaagggcccatgaaaaaatacaggtgtctagactgccagggagaccctggcccccagtagtgtgtcctggggacttcctcagagcgagaaacctcccccaatgtcttcaagacttttctctccccccgcccaaccccgtctctccctcccttgccacccaaatgttagaaaaatagctgtgaacagagagcgcttttgtctgcaatggcagcaggatctggacggtcccctcccctaagttcccccctccccaccccacactctgacagcttgttccgtgttgcccccccacccagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtaaaaaaaaaaaaaaaaaaaaactcgagggggggcccggtacccaatncgccctatagtgagtcgtnttacaattcactggccgtcgttttaancgtcgtgactgggaaaancctggcgttacccaacttaatcgcctggcagnacatccccctttcgccagntggngtaatagngaagaggcccnaccgatcgccctcccaacagtgggcagcctgaatggggattggaaattgtaagcgtaatattnggtaaaatccggtaaatttgggtaatcagtcatttttaaccaataggcgaatcgg

SEQ ID NO: 736752 - DNA, 3284 bp, Homo sapiens
ggcgcgggggcggggggcgccgcgcggccggaactgcgggcggggggcttcccgggggcggggggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaagtcctgtcctgcagggtgggatcagccctgccaggtgggccgccttcctggagacccgtagatgccagggctggaagctttcatttgccgggacactcgggcccatgggattgcacagagctggagggaggggtgagataggggcagataggagctgcaggggtgcctggcgagcctctggttttcctctgctcctctgcctgtcctctcccaactcaaggttctagtgggaaggggtgcccccaggctctcatgttcctggcgtgagatgaaaggatccctgcggagggtttggttcttgagggctgggggtggacttgggaacaggctgtgtgtttgtcccagcgatggtgcctgcttagcttcccgtccccaccccccagccccttggccctctcctgtctgccctagggagaaggcaggtggacaagggcccatgaaaaaatacaggtgtctagactgccagggagaccctggcccccagtagtgtgtcctggggacttcctcagagcgagaaacctcccccaatgtcttcaagacttttctctccccccgcccaaccccgtctctccctcccttgccacccaaatgttagaaaaatagctgtgaacagagagcgcttttgtctgcaatggcagcaggatctggacggtcccctcccctaagttcccccctccccaccccacactctgacagcttgttccgtgttgcccccccacccagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtaaagatgggtcagatggacttgcagggtgaaatgggatggtacttgcagggtgagatgggatggtactcacttgagggtttgagatgtgggggatgtactgctgggtgagataggatgt

SEQ ID NO: 736753 - DNA, 4065 bp, Homo sapiens
  misc_feature (3809)..(3809): n is a, c, g, or t
  misc_feature (3828)..(3828): n is a, c, g, or t
  misc_feature (3855)..(3855): n is a, c, g, or t
  misc_feature (3873)..(3873): n is a, c, g, or t
  misc_feature (3905)..(3905): n is a, c, g, or t
  misc_feature (3924)..(3924): n is a, c, g, or t
  misc_feature (3928)..(3928): n is a, c, g, or t
  misc_feature (3936)..(3936): n is a, c, g, or t
  misc_feature (3947)..(3947): n is a, c, g, or t
  misc_feature (4010)..(4010): n is a, c, g, or t
ggcgcgggggcggggggcgccgcgcggccggaactgcgggcggggggcttcccgggggcggggggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaagtcctgtcctgcagggtgggatcagccctgccaggtgggccgccttcctggagacccgtagatgccagggctggaagctttcatttgccgggacactcgggcccatgggattgcacagagctggagggaggggtgagataggggcagataggagctgcaggggtgcctggcgagcctctggttttcctctgctcctctgcctgtcctctcccaactcaaggttctagtgggaaggggtgcccccaggctctcatgttcctggcgtgagatgaaaggatccctgcggagggtttggttcttgagggctgggggtggacttgggaacaggctgtgtgtttgtcccagcgatggtgcctgcttagcttcccgtccccaccccccagccccttggccctctcctgtctgccctagggagaaggcaggtggacaagggcccatgaaaaaatacaggtgtctagactgccagggagaccctggcccccagtagtgtgtcctggggacttcctcagagcgagaaacctcccccaatgtcttcaagacttttctctccccccgcccaaccccgtctctccctcccttgccacccaaatgttagaaaaatagctgtgaacagagagcgcttttgtctgcaatggcagcaggatctggacggtcccctcccctaagttcccccctccccaccccacactctgacagcttgttccgtgttgcccccccacccagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggtgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtaaaaaaaaaaaaaaaaaaaaactcgagggggggcccggtacccaatncgccctatagtgagtcgtnttacaattcactggccgtcgttttaancgtcgtgactgggaaaancctggcgttacccaacttaatcgcctggcagnacatccccctttcgccagntggngtaatagngaagaggcccnaccgatcgccctcccaacagtgggcagcctgaatggggattggaaattgtaagcgtaatattnggtaaaatccggtaaatttgggtaatcagtcatttttaaccaataggcgaatcgg

SEQ ID NO: 736754 - DNA, 3863 bp, Homo sapiens
  misc_feature (3607)..(3607): n is a, c, g, or t
  misc_feature (3626)..(3626): n is a, c, g, or t
  misc_feature (3653)..(3653): n is a, c, g, or t
  misc_feature (3671)..(3671): n is a, c, g, or t
  misc_feature (3703)..(3703): n is a, c, g, or t
  misc_feature (3722)..(3722): n is a, c, g, or t
  misc_feature (3726)..(3726): n is a, c, g, or t
  misc_feature (3734)..(3734): n is a, c, g, or t
  misc_feature (3745)..(3745): n is a, c, g, or t
  misc_feature (3808)..(3808): n is a, c, g, or t
ggcgcgggggcggggggcgccgcgcggccggaactgcgggcggggggcttcccgggggcggggggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaagtcctgtcctgcagggtgggatcagccctgccaggtgggccgccttcctggagacccgtagatgccagggctggaagctttcatttgccgggacactcgggcccatgggattgcacagagctggagggaggggtgagataggggcagataggagctgcaggggtgcctggcgagcctctggttttcctctgctcctctgcctgtcctctcccaactcaaggttctagtgggaaggggtgcccccaggctctcatgttcctggcgtgagatgaaaggatccctgcggagggtttggttcttgagggctgggggtggacttgggaacaggctgtgtgtttgtcccagcgatggtgcctgcttagcttcccgtccccaccccccagccccttggccctctcctgtctgccctagggagaaggcaggtggacaagggcccatgaaaaaatacaggtgtctagactgccagggagaccctggcccccagtagtgtgtcctggggacttcctcagagcgagaaacctcccccaatgtcttcaagacttttctctccccccgcccaaccccgtctctccctcccttgccacccaaatgttagaaaaatagctgtgaacagagagcgcttttgtctgcaatggcagcaggatctggacggtcccctcccctaagttcccccctccccaccccacactctgacagcttgttccgtgttgcccccccacccagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtaaaaaaaaaaaaaaaaaaaaactcgagggggggcccggtacccaatncgccctatagtgagtcgtnttacaattcactggccgtcgttttaancgtcgtgactgggaaaancctggcgttacccaacttaatcgcctggcagnacatccccctttcgccagntggngtaatagngaagaggcccnaccgatcgccctcccaacagtgggcagcctgaatggggattggaaattgtaagcgtaatattnggtaaaatccggtaaatttgggtaatcagtcatttttaaccaataggcgaatcgg

SEQ ID NO: 736755 - DNA, 4030 bp, Homo sapiens
  misc_feature (3774)..(3774): n is a, c, g, or t
  misc_feature (3793)..(3793): n is a, c, g, or t
  misc_feature (3820)..(3820): n is a, c, g, or t
  misc_feature (3838)..(3838): n is a, c, g, or t
  misc_feature (3870)..(3870): n is a, c, g, or t
  misc_feature (3889)..(3889): n is a, c, g, or t
  misc_feature (3893)..(3893): n is a, c, g, or t
  misc_feature (3901)..(3901): n is a, c, g, or t
  misc_feature (3912)..(3912): n is a, c, g, or t
  misc_feature (3975)..(3975): n is a, c, g, or t
ggcgcgggggcggggggcgccgcgcggccggaactgcgggcggggggcttcccgggggcggggggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaagtcctgtcctgcagggtgggatcagccctgccaggtgggccgccttcctggagacccgtagatgccagggctggaagctttcatttgccgggacactcgggcccatgggattgcacagagctggagggaggggtgagataggggcagataggagctgcaggggtgcctggcgagcctctggttttcctctgctcctctgcctgtcctctcccaactcaaggttctagtgggaaggggtgcccccaggctctcatgttcctggcgtgagatgaaaggatccctgcggagggtttggttcttgagggctgggggtggacttgggaacaggctgtgtgtttgtcccagcgatggtgcctgcttagcttcccgtccccaccccccagccccttggccctctcctgtctgccctagggagaaggcaggtggacaagggcccatgaaaaaatacaggtgtctagactgccagggagaccctggcccccagtagtgtgtcctggggacttcctcagagcgagaaacctcccccaatgtcttcaagacttttctctccccccgcccaaccccgtctctccctcccttgccacccaaatgttagaaaaatagctgtgaacagagagcgcttttgtctgcaatggcagcaggatctggacggtcccctcccctaagttcccccctccccaccccacactctgacagcttgttccgtgttgcccccccacccagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtaaaaaaaaaaaaaaaaaaaaactcgagggggggcccggtacccaatncgccctatagtgagtcgtnttacaattcactggccgtcgttttaancgtcgtgactgggaaaancctggcgttacccaacttaatcgcctggcagnacatccccctttcgccagntggngtaatagngaagaggcccnaccgatcgccctcccaacagtgggcagcctgaatggggattggaaattgtaagcgtaatattnggtaaaatccggtaaatttgggtaatcagtcatttttaaccaataggcgaatcgg

SEQ ID NO: 736756 - DNA, 3783 bp, Homo sapiens
  misc_feature (3527)..(3527): n is a, c, g, or t
  misc_feature (3546)..(3546): n is a, c, g, or t
  misc_feature (3573)..(3573): n is a, c, g, or t
  misc_feature (3591)..(3591): n is a, c, g, or t
  misc_feature (3623)..(3623): n is a, c, g, or t
  misc_feature (3642)..(3642): n is a, c, g, or t
  misc_feature (3646)..(3646): n is a, c, g, or t
  misc_feature (3654)..(3654): n is a, c, g, or t
  misc_feature (3665)..(3665): n is a, c, g, or t
  misc_feature (3728)..(3728): n is a, c, g, or t
ggcgcgggggcggggggcgccgcgcggccggaactgcgggcggggggcttcccgggggcggggggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtaaaaaaaaaaaaaaaaaaaaactcgagggggggcccggtacccaatncgccctatagtgagtcgtnttacaattcactggccgtcgttttaancgtcgtgactgggaaaancctggcgttacccaacttaatcgcctggcagnacatccccctttcgccagntggngtaatagngaagaggcccnaccgatcgccctcccaacagtgggcagcctgaatggggattggaaattgtaagcgtaatattnggtaaaatccggtaaatttgggtaatcagtcatttttaaccaataggcgaatcgg

SEQ ID NO: 736757 - DNA, 3038 bp, Homo sapiens
  misc_feature (2782)..(2782): n is a, c, g, or t
  misc_feature (2801)..(2801): n is a, c, g, or t
  misc_feature (2828)..(2828): n is a, c, g, or t
  misc_feature (2846)..(2846): n is a, c, g, or t
  misc_feature (2878)..(2878): n is a, c, g, or t
  misc_feature (2897)..(2897): n is a, c, g, or t
  misc_feature (2901)..(2901): n is a, c, g, or t
  misc_feature (2909)..(2909): n is a, c, g, or t
  misc_feature (2920)..(2920): n is a, c, g, or t
  misc_feature (2983)..(2983): n is a, c, g, or t
ggcgcgggggcggggggcgccgcgcggccggaactgcgggcggggggcttcccgggggcggggggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtaaaaaaaaaaaaaaaaaaaaactcgagggggggcccggtacccaatncgccctatagtgagtcgtnttacaattcactggccgtcgttttaancgtcgtgactgggaaaancctggcgttacccaacttaatcgcctggcagnacatccccctttcgccagntggngtaatagngaagaggcccnaccgatcgccctcccaacagtgggcagcctgaatggggattggaaattgtaagcgtaatattnggtaaaatccggtaaatttgggtaatcagtcatttttaaccaataggcgaatcgg

SEQ ID NO: 736758 - DNA, 719 bp, Homo sapiens
ggcgcgggggcggggggcgccgcgcggccggaactgcgggcggggggcttcccgggggcggggggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccgtacacctggaagtcctcgaacttgaaggaggcagagcaggggaggtggctga

SEQ ID NO: 736759 - DNA, 4558 bp, Homo sapiens
  misc_feature (4302)..(4302): n is a, c, g, or t
  misc_feature (4321)..(4321): n is a, c, g, or t
  misc_feature (4348)..(4348): n is a, c, g, or t
  misc_feature (4366)..(4366): n is a, c, g, or t
  misc_feature (4398)..(4398): n is a, c, g, or t
  misc_feature (4417)..(4417): n is a, c, g, or t
  misc_feature (4421)..(4421): n is a, c, g, or t
  misc_feature (4429)..(4429): n is a, c, g, or t
  misc_feature (4440)..(4440): n is a, c, g, or t
  misc_feature (4503)..(4503): n is a, c, g, or t
ggcgcgggggcggggggcgccgcgcggccggaactgcgggcggggggcttcccgggggcggggggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaaccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaagtcctgtcctgcagggtgggatcagccctgccaggtgggccgccttcctggagacccgtagatgccagggctggaagctttcatttgccgggacactcgggcccatgggattgcacagagctggagggaggggtgagataggggcagataggagctgcaggggtgcctggcgagcctctggttttcctctgctcctctgcctgtcctctcccaactcaaggttctagtgggaaggggtgcccccaggctctcatgttcctggcgtgagatgaaaggatccctgcggagggtttggttcttgagggctgggggtggacttgggaacaggctgtgtgtttgtcccagcgatggtgcctgcttagcttcccgtccccaccccccagccccttggccctctcctgtctgccctagggagaaggcaggtggacaagggcccatgaaaaaatacaggtgtctagactgccagggagaccctggcccccagtagtgtgtcctggggacttcctcagagcgagaaacctcccccaatgtcttcaagacttttctctccccccgcccaaccccgtctctccctcccttgccacccaaatgttagaaaaatagctgtgaacagagagcgcttttgtctgcaatggcagcaggatctggacggtcccctcccctaagttcccccctccccaccccacactctgacagcttgttccgtgttgcccccccacccagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtaaaaaaaaaaaaaaaaaaaaactcgagggggggcccggtacccaatncgccctatagtgagtcgtnttacaattcactggccgtcgttttaancgtcgtgactgggaaaancctggcgttacccaacttaatcgcctggcagnacatccccctttcgccagntggngtaatagngaagaggcccnaccgatcgccctcccaacagtgggcagcctgaatggggattggaaattgtaagcgtaatattnggtaaaatccggtaaatttgggtaatcagtcatttttaaccaataggcgaatcgg

SEQ ID NO: 736760 - DNA, 1372 bp, Homo sapiens
gccatccccaaacccatccccaagccaaactcaacaccatccccttccctaatcacctctcctgcccctagctcagcctcatccccaactccatgcctgtctccaatcccaaccctgcccccaatctcccctcaactccaatccataacccccttcaaaccatcctcaactaagctcctctccagccctggccacatccccatcctcccccaacctccagccccaacacccatcatccccctgagctcacccttaactccaatttatcctccaagcctatctctcaccatccagccctcacctagccatttcccaaccctagtcctccaccgtcccgaagccaacttcacccatgtccccatccccaatcttgtccccattcctgactccaaatccaacccctaagcctccccaagctcctcctcatctaaccttgtctccagccccaaccacatggccgtcctcacctccaatccgtaaccatcccagaccgatcccaaagccaactccagctacattcccacctccaaccccaatagcatctgcatccccatgcccaaccctaaccccagtgccattaccagcccctaccccatccctatgccatccccacccagcacacccccatcctcacctccatccccagccgcatcctagtcccacccacccccatcctcagttcctccccctgccgtgtgcacctccaacacgacgcctccgcccgctgcctcctccccccaggccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaagggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaccaaaaaaa

SEQ ID NO: 736761 - DNA, 438 bp, Homo sapiens
ttaggagcccggctcatgagtctgagtggggagaactcctgagagaggagccccgacttcagagtcccagctccaagcccagggccatgcccgtgtctgcctcagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactgtgagtctgtgctggcctttgacctctgacctcaggctccacacctcatgagg

SEQ ID NO: 736762 - DNA, 708 bp, Homo sapiens
  misc_feature (12)..(12): n is a, c, g, or t
  misc_feature (15)..(15): n is a, c, g, or t
  misc_feature (18)..(18): n is a, c, g, or t
  misc_feature (21)..(21): n is a, c, g, or t
  misc_feature (31)..(31): n is a, c, g, or t
  misc_feature (37)..(37): n is a, c, g, or t
  misc_feature (52)..(52): n is a, c, g, or t
ctctcgctcctngtngtnttntttatagctnaaaacnaagggggcccttctncccccaccgcgggagaagggggctcgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaagggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaccaaaaaaa

SEQ ID NO: 736763 - DNA, 1558 bp, Homo sapiens
accgaccgctcgggagctcgcccccgcctagcctcggctgagatgcagggctctgagctccaggtcacaatgcacgacacccggggccgcagtcccccataccagctggactcccaggggcgcctggtgctggctgaggccaggtggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggttcagggggcagggagggggtgggcttggatggggacagtgtggggtgtgggacctggacaaacaggacgagttcctgagtccctggctggggactccatcttctgctcgatgcctctcttctctctctctctcctctcccttcactttcttcccatccccaccacccacaggctcgccagagctaaagacagcggaaatagagcccaaggcagatggcagctggagggaaggagacgaagtcacactcatctgctctgcccgcggccatccagaccccaaactcagctggagccaattggggggcagcgtaagggaccttcctctccaccctgagccccctctcactcatccaagtatcacaccccatcatctgtggacactggagtctggaataaatgctgtttgtcacatcaacaccaaaaaaa

SEQ ID NO: 736764 - DNA, 1753 bp, Homo sapiens
accgaccgctcgggagctcgcccccgcctagcctcggctgagatgcagggctctgagctccaggtcacaatgcacgacacccggggccgcagtcccccataccagctggactcccaggggcgcctggtgctggctgaggccaggtggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgtgagtggcctgctatctgcaatgaccaccatagcttaaccccatccccaccctcaaccccaagctcaacccataacctcaaccacatcttatcctccaccccacatcccaccacatccacctccatccccaacccatcctcatccccaactacagccccaaacccagccccagactaatccacagccatccccaa

SEQ ID NO: 736765 - DNA, 2188 bp, Homo sapiens
accgaccgctcgggagctcgcccccgcctagcctcggctgagatgcagggctctgagctccaggtcacaatgcacgacacccggggccgcagtcccccataccagctggactcccaggggcgcctggtgctggctgaggccaggtggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaagggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaccaaaaaaa

SEQ ID NO: 736766 - DNA, 2138 bp, Homo sapiens
accgaccgctcgggagctcgcccccgcctagcctcggctgagatgcagggctctgagctccaggtcacaatgcacgacacccggggccgcagtcccccataccagctggactcccaggggcgcctggtgctggctgaggccaggtggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaagggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattccccccccccatcatctgtggacactggagtctggaataaatgctgtttgtcacatcaacaccaaaaaaa

SEQ ID NO: 736767 - DNA, 2184 bp, Homo sapiens
  misc_feature (2176)..(2176): n is a, c, g, or t
accgaccgctcgggagctcgcccccgcctagcctcggctgagatgcagggctctgagctccaggtcacaatgcacgacacccggggccgcagtcccccataccagctggactcccaggggcgcctggtgctggctgaggccaggtggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaagggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattccccccccctcagttcacagtggagactatggagattcagggcaggatccctcaggtacaagaaacaccttccgaagattttgctctccttccttccctccctcttgncaactccc

SEQ ID NO: 736768 - DNA, 2424 bp, Homo sapiens
  misc_feature (2099)..(2099): n is a, c, g, or t
  misc_feature (2101)..(2101): n is a, c, g, or t
accgaccgctcgggagctcgcccccgcctagcctcggctgagatgcagggctctgagctccaggtcacaatgcacgacacccggggccgcagtcccccataccagctggactcccaggggcgcctggtgctggctgaggccaggtggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaagggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctttccgcttccctttttcttatncnctagcccacactttttagaatgaggtctgtcatatacttgattacatatgaaatctcagatgccaattttgtttaatgtgtcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggcccttaaggtggcatcaggatgctcttatgtccttccagaattagcatacacttcactccgctccccttcatctc

SEQ ID NO: 736769 - DNA, 2121 bp, Homo sapiens
  misc_feature (1895)..(1896): n is a, c, g, or t
accgaccgctcgggagctcgcccccgcctagcctcggctgagatgcagggctctgagctccaggtcacaatgcacgacacccggggccgcagtcccccataccagctggactcccaggggcgcctggtgctggctgaggccaggtggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaagggagagggagggtgggtgggtggcccccanncacgcaagttttcactgggtcttacccgacgtgagcccccactcctccatatggacctgttttggaccaatgaggcatcctcttctgtagtcctcaacacgcggagctccaccactcctgagcagtgtgacctcaggtgcttgctgcagaggcatcgggggtctctggccagaggtgacatctgaagcaatcgggatcctgtttggttttgccacatccgacctg

SEQ ID NO: 736770 - DNA, 1844 bp, Homo sapiens
accgaccgctcgggagctcgcccccgcctagcctcggctgagatgcagggctctgagctccaggtcacaatgcacgacacccggggccgcagtcccccataccagctggactcccaggggcgcctggtgctggctgaggccaggtggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaccaaaaaaa

SEQ ID NO: 736771 - DNA, 1469 bp, Homo sapiens
accgaccgctcgggagctcgcccccgcctagcctcggctgagatgcagggctctgagctccaggtcacaatgcacgacacccggggccgcagtcccccataccagctggactcccaggggcgcctggtgctggctgaggccaggtggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccacagagagagcgtcgacgctctctctgtggggtatctcactgcccagg

SEQ ID NO: 736772 - DNA, 2051 bp, Homo sapiens
accgaccgctcgggagctcgcccccgcctagcctcggctgagatgcagggctctgagctccaggtcacaatgcacgacacccggggccgcagtcccccataccagctggactcccaggggcgcctggtgctggctgaggccaggtggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactgatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaagggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaccaaaaaaa

SEQ ID NO: 736773 - DNA, 629 bp, Homo sapiens
accgaccgctcgggagctcgcccccgcctagcctcggctgagatgcagggctctgagctccaggtcacaatgcacgacacccggggccgcagtcccccataccagctggactcccaggggcgcctggtgctggctgaggccaggtggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatctcacggaacagctacagatctatgattgcgcagtcgagcacgtacacc

SEQ ID NO: 736774 - DNA, 1544 bp, Homo sapiens
gccctgaaaggggaaagactgtgcaagctgccggtctagcttcggaaacgatacgtattgtacgatagttacgaacgatacgtactgtcgtttccttcctacctcgtcctcaccccaccccgagtgaaacttttcgagtgtgaaccttacttttttcccgttctcctcaaggcagtttgaacgacacaggtttggaaggaatagttaactctccagtattactggaacatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaagggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaccaaaaaaa

SEQ ID NO: 736775 - DNA, 3475 bp, Homo sapiens
  misc_feature (389)..(389): n is a, c, g, or t
  misc_feature (2084)..(2084): n is a, c, g, or t
  misc_feature (2189)..(2189): n is a, c, g, or t
acagccgggaacgcgcctcgcggatgacaacaaattcgtcgcgcggcggcagtggcggtggctgcctcagcccctgccgcctcctctcgcgctctcttgcactctctccgagccggttgggaccctcctcggaagtcccctggcctggggccaggaggacccctctgcgtcttgcctccgccaggcccagcgcgagcggtgcggcgccggcgatggggtctccctgagggactcccggcaccaaatagggatggaggggccgccccaggcttaggccccgccgcggcctggagccggagtcgctaccccgaggccggagccgtcgcaacccgcagccgcagtcagcccagctgccagcagtcactatgccttggccgttttcggagtcnatcaagaagagggcctgccggtacctcctgcagaggtacctgggccactttctgcaggagaagctgagcctggagcagctcagcctggacctgtaccaaggcaccgggtccctcgcccaggtccccttggacaaatggtgtctcaatgagatcttggagtcagcagatgcacccttagaagtcactgaaggattcattcagtcaatttccctgtcagttccatggggctctttactgcaggataattgtgcactggaagtgagaggattagaaatggtcttccggcctagacctcgcccagcaactggttctgagcctatgtattggtcaagttttatgaccagcagtatgcaattggcaaaagaatgtcttagccagaaactaacagatgaacaaggagaaggatcccagccttttgaaggacttgaaaagtttgctgaaaccattgaaacagtactaagaagagtaaaagtcacttttatagatactgttttgagaattgaacatgtgccagaaaattccaaaactggaactgcacttgaaattcgaatagaaagaactgtgtactgtgatgaaactgctgacgaatcctcaggaattaatgtgcatcaacccactgcttttgctcacaagttacttcagctctctggagtgtctctcttctgggatgagttttctgcatcagccaaatcttccccagtgtgttcaactgcaccagtggaaactgagccaaagctctcacctagctggaaccccaaaattatttatgagccacacccacagctaactagaaatttaccagagatagcaccttctgacccagtgcagattggacggttaattggtaggttggagttgagtctcacgttgaaacagaatgaagtgcttcctggagctaagttggatgttgatggacagatagactctattcatctactcctgtcaccaagacaggtgcacttgcttttggatatgttggcagctattgctggaccagaaaattctagcaaaatagggttagctaataaagataggaaaaatcgacccatgcagcaggaagacgagtatcgaattcagatggaattaaaccggtattatttgagaaaagattccctctctgtgggtgtatcttcagagcaaagcttttatgagacagaaacagctcgtacaccttctagccgtgaagaagaagtattcttctccatggctgatatggacatgtctcatagtctctcttctcttccaccccttggggaccccccaaacatggaccttgagttatcattaactagtacatatacaaataccccagcaggatctccattaagtgctactgtgcttcagcccacttggggagagttccttgatcatcataaagaacagccagtaagagggtcaacatttccatccaacctagttcacccaacacctttacagaagacatctctcccatctagatctgtttcagtggatgaatcaaggcctgaacttatttttagactagctgtgggaactttttcaatctctgtgcttcacattgatcctttatctccacctgaaacgtcacagaaccttaatccattgacacctatggcagtagctttctttacttgtatagaaaagattgatccagcaagattttcaacagaagattttaagtctttccgagcagtgtttgcagaagcttgctcacangatcaccttagatttataggtactggcattaaagtatcctatgaacaaagacaaagatcagcttcccgatattttagtactgatatgtccattgggcaaatggantttttggagtgcctatttccaactgattttcattctgttcctcctcactatacagagcttttaacgttccattccaaagaagaaactggttcccattcccctgtgtgtcttcagcttcattataagcattctgagaatagagggccccagggtaatcaagcaagacttagttcagttcctcacaaggcagaattgcaaattaaattaaatccagtgtgttgtgagctggatatcagtattgtggacaggttaaattccttgcttcaaccacagaaacttgccacagtagagatgatggcatcccacatgtatacttcatataataaacatattagtctgcacaaggctttcactgaagtgtttctagatgattcacatagtcctgcaaattgtcggatatcagtacaagttgccacaccagcattaaacctttctgttcgcttcccaatacctgatcttcgatctgatcaagaaagaggaccatggtttaagaagtcacttcagaaggagatcctttatttagccttcacagatctagaatttaagactgaatttataggaggatcaaccccagaacaaattaaattggaacttacctttagagaactaattggatcgttccaggaagagaaaggagatccatctattaagtttttccatgtgtctagtggagtagatggagatacaacatcgtcagatgactttgactggccacgaattgtactgaaaataaatccaccagccatgcattccattttggagagaattgcagctgaagaagaagaggagaatgatggtcactaccaggaggaagaggaaggaggtgctcattccttgaaagatgtttgtgatctaagaagaccagccccatctcctttttcttctcgtagagtaatgtttgaaaatgaacagatggtgatgccaggagaccctgtagaaatgacagaatttcaggataaagcaatcagcaattctcactatgtgctggaacttacgttaccaaatatttatgtaacactacctaataagagcttttatgagaagctttataataggatctttaatgacttgctactgtgggaaccaacagctccttcaccagtggagacattcgagaatatttcctatggcattgggctttcagtagccagtcagctcattaatactttcaacaaagatagttttagtgcatttaaatctgcagttcactatgatgaggaaagtggatctgaggaggagactttgcagtatttttccactgttgatcccaactatcgttctcgcag

SEQ ID NO: 736776 - DNA, 1348 bp, Homo sapiens
  misc_feature (389)..(389): n is a, c, g, or t
acagccgggaacgcgcctcgcggatgacaacaaattcgtcgcgcggcggcagtggcggtggctgcctcagcccctgccgcctcctctcgcgctctcttgcactctctccgagccggttgggaccctcctcggaagtcccctggcctggggccaggaggacccctctgcgtcttgcctccgccaggcccagcgcgagcggtgcggcgccggcgatggggtctccctgagggactcccggcaccaaatagggatggaggggccgccccaggcttaggccccgccgcggcctggagccggagtcgctaccccgaggccggagccgtcgcaacccgcagccgcagtcagcccagctgccagcagtcactatgccttggccgttttcggagtcnatcaagaagagggcctgccggtacctcctgcagaggtacctgggccactttctgcaggagaagctgagcctggagcagctcagcctggacctgtaccaaggcaccgggtccctcgcccaggtccccttggacaaatggtgtctcaatgagatcttggagtcagcagatgcacccttagaagtcactgaaggattcattcagtcaatttccctgtcagttccatggggctctttactgcaggataattgtgcactggaagtgagaggattagaaatggtcttccggcctagacctcgcccagcaactggttctgagcctatgtattggtcaagttttatgaccagcagtatgcaattggcaaaagaatgtcttagccagaaactaacagatgaacaaggagaaggatcccagccttttgaaggacttgaaaagtttgctgaaaccattgaaacagtactaagaagagtaaaagtcacttttatagatactgttttgagaattgaacatgtgccagaaaattccaaaactggaactgcacttgaaattcgaatagaaagaactgtgtactgtgatgaaactgctgacgaatcctcaggaattaatgtgcatcaacccactgcttttgctcacaagttacttcagctctctggagtgtctctcttctgggatgagttttctgcatcagccaaatcttccccagtgtgttcaactgcaccagtggaaactgagccaaagctctcacctagctggaaccccaaaattatttatgagccacacccacagctaactagaaatttaccagagatagcaccttctgacccagtgcagattggacggttaattggtaggttggagttgagtctcacgttgaaacagaatgaagtgcttcctggagctaaggtcagtgtttgtttcactttctgtagtaaaaccaaaataaaagtacaagtattctttat

SEQ ID NO: 736777 - DNA, 4937 bp, Homo sapiens
cgcggtgctctcgctcctgggctgcgccagtccgaggcggtgccggctcctttgcctccccgagtcgcagatgctgcgggcgcctccgggaaaagatctgggcggcgcgctcgctcgatggacacaggaagatccagaagctagtggcacatctagcaacagagccagatcagaacccaggcaagaagtgcacgtttaaacctcattatctggctaagtataaacctcagggagaaaaggggtttgtttttgtttttctcagtctataagctaacattgagctgactttcagagtccaggcaaatatgtttggtgggtcaccacccagaaaggaattctcttagcactgaatcagggctctgtatgtaaagtataaatcccctaagagaactcctcaccctcctacacagacacattggtgcatgcacacacaccccactctctgcacagagagcatctgagctaggagctggcaagtggggcaccagtcctgtagcaaagaggcacaccacacacacacacacacacacacacacacactctctctctctctctctctcactcacacacacacacacacacacacacacacgcttctcccttgcttgggaatctgggagaagaaccccccacccccacccctgccctccataggcattgtgtaggtgagagaaagagggaggagtgagagagaacacacagaggggcccaaggaggtgccaggccattagcagggcccctccttgagaaacccctctgcaggagcttctcctgccgccagccaggttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctccttttttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaacccaaaaaaaaag

SEQ ID NO: 736778 - DNA, 702 bp, Homo sapiens
tcaggattcggctttagctcgagttttttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaacccaaaaaaaaag

SEQ ID NO: 736779 - DNA, 7678 bp, Homo sapiens
gcggccgccctctaccctcaatccccactggagattcctcaccccgggaccgtccgcgcgggcgtggtcgggctccgcgcctcgcgcagcggggtggcacaggcggccagggagggcccacgcacccggcgcgagctagaagcctccggtcggcctgcagtgcccaagtcccatggcgagggcagcccgagtggccgtcgcggctgtaggtccgcatgccgggcaccgcaccaggcgtctagcaggtaggggcagggaaggtagggctgcgctggcggccggtgcccagttaccggcgatcggggacgctcggagacacctggtctcccggaagcgcccttcggaaatgggattcgacccggcttgcgggcggcgggtgtttagaagaagaggctgcgggcaagcagtgccccctctctggttccccggactcctcttagccccctcgtggcctgatgggcggccgggacggaggtgggctgtaagcccgccggcacccaccgtgtcctgtggaaggcttggagacctgagccaggctctactcggttagatgcgagtgagacaggcgacggagttcgtctttaagcctcccttgcctcagcaaggagagggagcgttttccttattttaatgaccgcctttccctcccttggggtcccagttcaccctgaacctttccacagccttaaaagcccgctctccctagcggagtgctgcggcagttcttcagaagacacggggccaaatgaaacttacttaaagtggttatcgcgtttcaggctgatttgttcctagtaactacgttttggaaagcagctgtggactctcaaggacaggcaggaacgaagacctccttagggtccgagtgtcgcttcccacagttagattacccatgaatttccttgattctgtaggtctcaagaatctcatgagcccccaaccacctccacctttctctctgaatctctctcctgtctctgaaattcttcgcaaaaataatctgtcctcaaggaatattgaaagcgtcatcaatgtcttgaaggaaattactgtatctgagaaccgaaactagtatttgatgtttcactttcaaatacatttttttttaataaaaaggatacctttaagtaaaacactaccactgctatttacgtttaagtagatttttaattcatattaagcagtagtgtgctttttggaaagatgatggactgggactcataatccctgggttttgtttctatttgtagtttcttgagtaagtcagcactttccctggttaagaaatgacctcatctgtaaaatgaacctgacttctaaggtcttgttcggctctcacgtctttacttcagttaaatattgacataatacatgtttgttgaatgaatgactgaatgaataaatcttattgctctaggaactatgtgcttttaacctttggaaatacatagaaacaaatgcctcctttgctaggaaagggagcttaattgtgctcccactgcatcagactgcttccatctaatgatgcaattgcaatacagggtgggaggccatccacagggctgtccctctgcctcagagctcatctcaagtttgcccttctctatggagaaggaaaatttgagtctccagaaggaaagtattttgctaaacgccaagcaagaattagagggtaagggggcttctgatgcctggtccaaggctcttagaagaagaagaaggagaaagggagaaagctcaagaaaataatgcacagatcaccagctacaggtggccctagtgcctaagtttataaactacccccgcccttcccggagagaaaggagcttgtataaagggaacaatcctagaacctaggcttaacaaggaaggagaaggggagaagcaagggtcattctgttctcaagtggtttgttgtatctgtgtgtttatctattccacatttggccaggcagtgggactccgggaaagcaagctgaagtgttttgtgggacaggcacatcatttggtcaactccttttccctggttgattccctccttttcctgacccatctcccccttcctaccagaggcaaccaaggcctttccaggcaacagcagacattatttaccccttgcgaattgattccacaatggaagactcttgggtccaaggagctgtaagataattaaggagaaaacagataatgaaggcaaaaatccaacacctggccattagcaatgctctggaaaggctatttaaacccgcattggatatcagagctgggagggcccatacagtctacctacctgccttttgcagatggacacaggaagatccagaagctagtggcacatctagcaacagagccagatcagaacccaggtaagctcggtctcaggccaggattccttttccatctcctctctttctcaggagccagtcttcctgcaccagcttcctcttttctcctagctcccctgcccctgcagcctggagggctcaaccacccttcctttggctcccactcccagctgaggctcagcctggcagtgcttttctgacacccacttcttttctccttcctccaggcaagaagtgcacgtttaaacctcattatctggctaagtataaacctcagggagaaaaggggtttgtttttgtttttctcagtctataagctaacattgagctgactttcagagtccaggcaaatatgtttggtgggtcaccacccagaaaggaattctcttagcactgaatcagggctctgtatgtaaagtataaatcccctaagagaactcctcaccctcctacacagacacattggtgcatgcacacacaccccactctctgcacagagagcatctgagctaggagctggcaagtggggcaccagtcctgtagcaaagaggcacaccacacacacacacacacacacacacacacactctctctctctctctctctcactcacacacacacacacacacacacacacacgcttctcccttgcttgggaatctgggagaagaaccccccacccccacccctgccctccataggcattgtgtaggtgagagaaagagggaggagtgagagagaacacacagaggggcccaaggaggtgccaggccattagcagggcccctccttgagaaacccctctgcaggagcttctcctgccgccagccaggttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtgtgagtaacccccacctcgcactgtctttcccatctctatctctcctctacacctgccgccagccccctgattcctgattttcccaccccctttttgcgctttttttttttttcctaaagcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtgcaagcatgtgtgttcccggggcgcgtgtgtgggtggcctcgggatgggggaatagggagcggagaaaagaaaccgctttggaaaatgcaatgatttcattctgccgtgttgctaaccccctcattctccctcgctcccactccgcctccttgctttaccatttttaatcgggcttccttgtttctttcttccctgcacccgcttcttccccctgcccccacctaaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctccttttttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaacccaaaaaaaaag

SEQ ID NO: 736780 - DNA, 7127 bp, Homo sapiens
gcggccgccctctaccctcaatccccactggagattcctcaccccgggaccgtccgcgcgggcgtggtcgggctccgcgcctcgcgcagcggggtggcacaggcggccagggagggcccacgcacccggcgcgagctagaagcctccggtcggcctgcagtgcccaagtcccatggcgagggcagcccgagtggccgtcgcggctgtaggtccgcatgccgggcaccgcaccaggcgtctagcaggtaggggcagggaaggtagggctgcgctggcggccggtgcccagttaccggcgatcggggacgctcggagacacctggtctcccggaagcgcccttcggaaatgggattcgacccggcttgcgggcggcgggtgtttagaagaagaggctgcgggcaagcagtgccccctctctggttccccggactcctcttagccccctcgtggcctgatgggcggccgggacggaggtgggctgtaagcccgccggcacccaccgtgtcctgtggaaggcttggagacctgagccaggctctactcggttagatgcgagtgagacaggcgacggagttcgtctttaagcctcccttgcctcagcaaggagagggagcgttttccttattttaatgaccgcctttccctcccttggggtcccagttcaccctgaacctttccacagccttaaaagcccgctctccctagcggagtgctgcggcagttcttcagaagacacggggccaaatgaaacttacttaaagtggttatcgcgtttcaggctgatttgttcctagtaactacgttttggaaagcagctgtggactctcaaggacaggcaggaacgaagacctccttagggtccgagtgtcgcttcccacagttagattacccatgaatttccttgattctgtaggtctcaagaatctcatgagcccccaaccacctccacctttctctctgaatctctctcctgtctctgaaattcttcgcaaaaataatctgtcctcaaggaatattgaaagcgtcatcaatgtcttgaaggaaattactgtatctgagaaccgaaactagtatttgatgtttcactttcaaatacatttttttttaataaaaaggatacctttaagtaaaacactaccactgctatttacgtttaagtagatttttaattcatattaagcagtagtgtgctttttggaaagatgatggactgggactcataatccctgggttttgtttctatttgtagtttcttgagtaagtcagcactttccctggttaagaaatgacctcatctgtaaaatgaacctgacttctaaggtcttgttcggctctcacgtctttacttcagttaaatattgacataatacatgtttgttgaatgaatgactgaatgaataaatcttattgctctaggaactatgtgcttttaacctttggaaatacatagaaacaaatgcctcctttgctaggaaagggagcttaattgtgctcccactgcatcagactgcttccatctaatgatgcaattgcaatacagggtgggaggccatccacagggctgtccctctgcctcagagctcatctcaagtttgcccttctctatggagaaggaaaatttgagtctccagaaggaaagtattttgctaaacgccaagcaagaattagagggtaagggggcttctgatgcctggtccaaggctcttagaagaagaagaaggagaaagggagaaagctcaagaaaataatgcacagatcaccagctacaggtggccctagtgcctaagtttataaactacccccgcccttcccggagagaaaggagcttgtataaagggaacaatcctagaacctaggcttaacaaggaaggagaaggggagaagcaagggtcattctgttctcaagtggtttgttgtatctgtgtgtttatctattccacatttggccaggcagtgggactccgggaaagcaagctgaagtgttttgtgggacaggcacatcatttggtcaactccttttccctggttgattccctccttttcctgacccatctcccccttcctaccagaggcaaccaaggcctttccaggcaacagcagacattatttaccccttgcgaattgattccacaatggaagactcttgggtccaaggagctgtaagataattaaggagaaaacagataatgaaggcaaaaatccaacacctggccattagcaatgctctggaaaggctatttaaacccgcattggatatcagagctgggagggcccatacagtctacctacctgccttttgcagatggacacaggaagatccagaagctagtggcacatctagcaacagagccagatcagaacccaggtaagctcggtctcaggccaggattccttttccatctcctctctttctcaggagccagtcttcctgcaccagcttcctcttttctcctagctcccctgcccctgcagcctggagggctcaaccacccttcctttggctcccactcccagctgaggctcagcctggcagtgcttttctgacacccacttcttttctccttcctccaggcaagaagtgcacgtttaaacctcattatctggctaagtataaacctcagggagaaaaggggtttgtttttgtttttctcagtctataagctaacattgagctgactttcagagtccaggcaaatatgtttggtgggtcaccacccagaaaggaattctcttagcactgaatcagggctctgtatgtaaagtataaatcccctaagagaactcctcaccctcctacacagacacattggtgcatgcacacacaccccactctctgcacagagagcatctgagctaggagctggcaagtggggcaccagtcctgtagcaaagaggcacaccacacacacacacacacacacacacacacactctctctctctctctctctcactcacacacacacacacacacacacacacacgcttctcccttgcttgggaatctgggagaagaaccccccacccccacccctgccctccataggcattgtgtaggtgagagaaagagggaggagtgagagagaacacacagaggggcccaaggaggtgccaggccattagcagggcccctccttgagaaacccctctgcaggagcttctcctgccgccagccaggttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtgtgagtaacccccacctcgcactgtctttcccatctctatctctcctctacacctgccgccagccccctgattcctgattttcccaccccctttttgcgctttttttttttttcctaaagcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtgcaagcatgtgtgttcccggggcgcgtgtgtgggtggcctcgggatgggggaatagggagcggagaaaagaaaccgctttggaaaatgcaatgatttcattctgccgtgttgctaaccccctcattctccctcgctcccactccgcctccttgctttaccatttttaatcgggcttccttgtttctttcttccctgcacccgcttcttccccctgcccccacctaaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctccttcccactcccacactgaaaaacaaagaagaaaaaagaaacaaaaccataaacaaaatctatgaagaaatgcattgtagaaacattcatgtccactgatggttcctaagaagagaagggaaaaagaaa

SEQ ID NO: 736781 - DNA, 485 bp, Homo sapiens
caccaccccgaatagcttcaggggccagaggaaatgctgccaaagcgttattggaaaactttggttttgaactggtcattcagtataacgaaaacaggcagaaggtacagaagaagggcaaaagtggtgaaggcgaaaacactgacaaactagaatgtggaacatgtggtaaattgttttccaatgttcttattttaaagagtcaccaagaacatgtacatgggcaattttttccatatgcagcgctagaaaaatttgctcgtcaatacagggaggcctatgacaagctttatccaatttctccatcttctccagaaacgccgcccccgccacctcctcctcctcccttgcctccggctcctccacagccttcttctatgggtcctgtaaagatccccaacacggtttctactcctctgcaagctccaccacccactcctcccccaccaccaccacctcctcctcctcctcctcctccaccacca

SEQ ID NO: 736782 - DNA, 3404 bp, Homo sapiens
ttatttaagcctcgaattctcttttaatgttttgtagtttttagtgtagacatcttatacttctattaatatatttctaaatatttttttggatgccattgtgaatggcatttattttattttctagttgtttgctgctactatatacacataaaaactgattatcttgtgacctttctaaattgatttttagttctagtagttattttgttttttttcttttgcaagcacaaatagttctacctcttttctgatctttatctctttctttttctttccttaatgtaatagttatggtctccagtacaatgttgaattgaactgatgagagtgaacaccattcttgccttgtttccaattttaagggaaaagcatttggtgtttcactattaagtatgatgttagctgtaggtattttatagatgccctttgttagttaatgaagtttccttctactctagtttgctaagaggtttgtttttttgttgttgtttttgtttttaccatgaatggatattgaattttgtcaaaggctttttctgatctagcaatccttgagaattgattccttttattttaaaaaaatatttcttagttttctggggttttagggatgaggtctcactatgttgtccaggctggactcaaattcttggcctcaagcagtcctcctgccttggccttgagtgtagctgggtctacaggtacatgccactgtgcccagcttgattctattctatacacaaaccgtactccccttcttcttcctcccaccaccattctaatatgcttaattatatctctttatgtgtttttacaaagtctgtattgtttatgaacatgtatgtttttacataactgtgtataaaaatgtctttacctatatataaaaatctttttccactgagcactatgtgtgtaagatccatctgtgttctttgggtatatctcatcaaattgttagcaactttatagcacagacagtgcaagtgctccatattgaaatactgtaaatgaggttttggaagaatgagtatagaatatgtgatcagaagtaactgcaaaactgagtcactgactgatgaaatccatggaaagaatgtggggttagaaggtggtcatgagtgcaaattctggatctgctctttactgctgtgtgatcttgggcaattaaccttttttgagccttggtttcttcttagaatgggagtgacaccttctatgattgttgtgaagattaaagataatgaagatgtaactgcctggtccctgataaactgtcacaatatgttgagacatattgtctcaacatacgtcacatatgttgagacaatatgtgagacagagtctcactctgccccccaggctggggtgcaatggtgcgatctcggctcactgcaacctctgcctcccgggttcaagccattcttctgcctcggcctcccgagtagctgggattacaggcacctgccaccacacccagataatttttgtatttttagtagagatgggatttcaccatgtaggccaggctggtctcgaactcctgacctcaggtgatccacccgcctcagcctcccaaagtactgggattacaggcgtgagccaccacacccagccagtgtcgtttctttccttcctcagggctggctctggggggaagcgagggtcaacagtttgtgtgtggtgagcccgaaggtgccaaagcacaccccacacagaggcactcttcacgcatctcagattggagataacagtaaatgactatgcagagtgtggtgtttaatgtcaatttttccttctgtcctctgcaggacaaagtggccttggagagtatgcctctgctaggcttcaccattgctccagaaaaggaagagggcagcagtgaagtaggacctatttttcacctttaccacaagaaaaccctattttatagcttcaaagcagaagataccaattcagctcagaggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgcagtgagttaaaatttagtaagatgaagatgtggaaaccaatgaaaagtacatttagaaatgcaggctttttagtagaaagaagctcttacagtttttactcatgataaatcttatcacctttcaaaaattgattgtggtgcctcaggtgaaatgagaagctatcagtaacagctactctcatcgaaagcactttattattttacggagctgcaacctccaattttgtgttttctaagtgatttacttaagtcaataacagatggaatcctgtggactaatgtgccaccagttttctaacaagggtgtacataaaatggatttgtgcagacctggctgtggcttgctggtgtgcaagcacacatcactttagaggggctgcgccccaccagataggaaggggaggattttctcctccagtcgaccttgtgacctgtatactaacataacttattaaaggaggggtccctcctcccccagagcagtcctcaacactatgtcagtgctggaaatgcagccactggcagatctggccccccagacgtcaccgcagggcctctgaagagtcaaggtctgctttaatttattgtgtgcctttctgtgtttacctcactcaagctgacaacattgtttatgggaatctatccttcttttagacacacggtaatccttgggctgtattactgaaggctttttattttttgagaggtgaaaaaaagagaaaacaagttagactccaaaggtgaattcctggtcttggcagatggctctgggaacagcgagggagcacagaagtcgtggcctgaggctgttctatgggcacttggggctaaatcgcctcctgagggtgactgttgcttattctgctggacaggtttttacataaagcaaagggcatgtgaggggtgggattccttgttactcttactgcaataaaaatcaattgtttgatatcctgtccccattctgttgctgccctgtcccctacaaaaaagggaatttgctgacaaactttttgtaaaaagcaccatctctggacttacttgcattaaatattttcaggggaatttttttttccagtttgcagttcttttaaaatgtttgcattaaacatgtaactaatggttca

SEQ ID NO: 736783 - DNA, 724 bp, Homo sapiens
cagcccagtccctgctacctggaggcctggaggtgaagggctgtccagcgccctggaaaagcgtcccctccccagcccccatagcctttgtctgttcctgcaggagggagggaggaagagtgcttgactttcaggtcccacttaacccccatggctcacattcctagagggattttacaggaatcagtgttccaaagacaagccgcaggcacgcctctcacctcccttccatgtggcttctttcggttacagagcggcctgtgagcatgagcttcccgctgtcttcaccccgcttctcgggcagtgccttttcatccgtcttccagagcattaacccctcgaccttcaagaagcagaagaaagtcccttcagccctgacagaggtaaagcaggcagggctacccaagtgggaagtagggcatttggaaggttcatggtcatcctgggtagacggagtcagaccctgccctgtcccagcctgaccagtctcttccagacagagcattcctaatggaagcatcccagctacgaggaccgacttgacagtgatggtgctaggcgacatctttcccatccttctctctacctctcccctcctcctctttcttttctctcctttttctcctgccccatagcttagatctagtacccaagcagactgcacagatcacgggggctcttcattctaaaggagccaaattcctgtgttggtccttccatgtca

SEQ ID NO: 736784 - DNA, 629 bp, Homo sapiens
tcatgcctgaaaccgctttccctggagggagttattcactccatggagggaggaaacagaggttcgggcaccattttccaatatgtggattctcccttccatgtggcttctttcggttacagagcggcctgtgagcatgagcttcccgctgtcttcaccccgcttctcgggcagtgccttttcatccgtcttccagagcattaacccctcgacctttgccacggggtggcggcggcggcgcccggcgctttgcatagtgggccgggccgctcccctcccctccccgcccgcggccgggcgaagcgagcgggttccccctgaccggcccggccggcgcaagggtgggggtggagggggaatggccgcggccccgccttatagttggccctccgccagcgccgccattttgttctcgacggagatggctccggctgggcgggctcccttcctccttatcctcctcctcctcccgcctgcagtcccttcttccttctctgccgggattttcacccctccgcttctagtccgcctttggcggccgtcgcagcccaaccgccgttttttctgaaggggagggtaaaagaaaaggaggaaggcgggtgcgaggcgcgacctcgtgagcgacggat

SEQ ID NO: 736785 - DNA, 862 bp, Homo sapiens
ggtggaaggacagtccagagcccttgtcatcgcacaggaactgctatcttcagagaaagcatacgtggagatgctccagcacttaaatctggatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttccttgcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagggtgcactgagcctcatctccaaagtcacagaccgtgccaacgacagcatggagcaaggggaaaacctgcagaagctggtccacattgagcacagcgtccggggccaaggggatctcctccagccaggaagggagtttctgaaggaagggacgctgatgaaagtaacagggaaaaacagacggccccggcacctatttctgatgaacgatgtgctcctgtacacctatccccagaaggatgggaagtaccggctgaagaacacattggctgtggccaacatgaaggtcagccgcctgtgatgaaaaagtgcctag

SEQ ID NO: 736786 - DNA, 3333 bp, Homo sapiens
agtatatcagggtgtggaaacagctctgcaccccttcttgattgctgaacactatgatgtgaatatttctacatagccaccacctttatcatttttagtgacagcttaatataccatagggtggatgcctataatttccttagacttcgttttgaaacaacatagctcatgaacctcttcaaagatgaataatgagaaagcaaaaccttctgcttcgttatagaaggaattacccaatctctcccctatcttgaaaaagaagagtgttcaccacgtggccacaacgagaggagagatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttccttgcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagggtgcactgagcctcatctccaaagtcacagaccgtgccaacgacagcatggagcaaggggaaaacctgcagaagctggtccacattgagcacagcgtccggggccaaggggatctcctccagccaggaagggagtttctgaaggaagggacgctgatgaaagtaacagggaaaaacagacggccccggcacctatttctgatgaacgatgtgctcctgtacacctatccccagaaggatgggaagtaccggctgaagaacacattggctgtggccaacatgaaggtcagccgccctgtgatggagaaagtgccctacgctctaaagattgagacttccgagtcctgcctgatgctgtctgcgagctcctgtgcagagagggacgagtggtatggctgtctgagcagagccctccctgaggactacaaggcccaggcgctggctgcattccaccatagcgtggagatacgagagaggctgggggttagccttggggagaggccccccaccctggtgcctgtcacacacgtcatgatgtgcatgaactgcggctgcgacttctccctcaccctgcggcgtcatcactgtcacgcctgtggcaagatcgtgtgccggaactgttcgcggaacaagtacccgctgaagtacctgaaggacaggatggccaaggtctgcgacggctgcttcggggagctgaagaagcggggcagggctgtcccgggcctgatgagagagcggcctgtgagcatgagcttcccgctgtcttcaccccgcttctcgggcagtgccttttcatccgtcttccagagcattaacccctcgaccttcaagaagcagaagaaagtcccttcagccctgacagaggtggctgcctctggagagggctctgccatcagtggctatctcagccggtgtaagaggggcaagcggcactggaagaagctctggtttgtcatcaaaggcaaagttctctacacctacatggccagtgaggacaaagtggccttggagagtatgcctctgctaggcttcaccattgctccagaaaaggaagagggcagcagtgaagtaggacctatttttcacctttaccacaagaaaaccctattttatagcttcaaagcagaagataccaattcagctcagaggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgcagtgagttaaaatttagtaagatgaagatgtggaaaccaatgaaaagtacatttagaaatgcaggctttttagtagaaagaagctcttacagtttttactcatgataaatcttatcacctttcaaaaattgattgtggtgcctcaggtgaaatgagaagctatcagtaacagctactctcatcgaaagcactttattattttacggagctgcaacctccaattttgtgttttctaagtgatttacttaagtcaataacagatggaatcctgtggactaatgtgccaccagttttctaacaagggtgtacataaaatggatttgtgcagacctggctgtggcttgctggtgtgcaagcacacatcactttagaggggctgcgccccaccagataggaaggggaggattttctcctccagtcgaccttgtgacctgtatactaacataacttattaaaggaggggtccctcctcccccagagcagtcctcaacactatgtcagtgctggaaatgcagccactggcagatctggccccccagacgtcaccgcagggcctctgaagagtcaaggtctgctttaatttattgtgtgcctttctgtgtttacctcactcaagctgacaacattgtttatgggaatctatccttcttttagacacacggtaatccttgggctgtattactgaaggctttttattttttgagaggtgaaaaaaagagaaaacaagttagactccaaaggtgaattcctggtcttggcagatggctctgggaacagcgagggagcacagaagtcgtggcctgaggctgttctatgggcacttggggctaaatcgcctcctgagggtgactgttgcttattctgctggacaggtttttacataaagcaaagggcatgtgaggggtgggattccttgttactcttactgcaataaaaatcaattgtttgatatcctgtccccattctgttgctgccctgtcccctacaaaaaagggaatttgctgacaaactttttgtaaaaagcaccatctctggacttacttgcattaaatattttcaggggaatttttttttccagtttgcagttcttttaaaatgtttgcattaaacatgtaactaatggttca

SEQ ID NO: 736787 - DNA, 1441 bp, Homo sapiens
agtatatcagggtgtggaaacagctctgcaccccttcttgattgctgaacactatgatgtgaatatttctacatagccaccacctttatcatttttagtgacagcttaatataccatagggtggatgcctataatttccttagacttcgttttgaaacaacatagctcatgaacctcttcaaagatgaataatgagaaagcaaaaccttctgcttcgttatagaaggaattacccaatctctcccctatcttgaaaaagaagagtgttcaccacgtggccacaacgagaggagagatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttccttgcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagggtgcactgagcctcatctccaaagtcacagaccgtgccaacgacagcatggagcaaggggaaaacctgcagaagctggtccacattgagcacagcgtccggggccaaggggatctcctccagccaggaagggagtttctgaaggaagggacgctgatgaaagtaacagggaaaaacagacggccccggcacctatttctgatgaacgatgtgctcctgtacacctatccccagaaggatgggaagtaccggctgaagaacacattggctgtggccaacatgaaggtcagccgccctgtgatggagaaagtgccctacgctctaaagattgagacttccgagtcctgcctgatgctgtctgcgagctcctgtgcagagagggacgagtggtatggctgtctgagcagagccctccctgaggactacaaggcccaggcgctggctgcattccaccatagcgtggagatacgagagaggctgggggttagccttggggagaggccccccaccctggtgcctgtcacacacgtcatgatgtgcatgaactgcggctgcgacttctccctcaccctgcggcgtcatcactgtcacgcctgtggcaagatcgtgtgccggaactgttcgcggaacaagtacccgctgaagtacctgaacgaactcgcgtccgtggggatgctctagagtcagcacg

SEQ ID NO: 736788 - DNA, 3343 bp, Homo sapiens
cccacgcgtccgcggacgcgtgggtcctgccagggctggcgcgttcacgaagctgtttgaagatcagagcagagccctgtccacagcaaacgaaaatgatggctacgtggacatgagcagcttcaacgcctttgagagcaaacagcagagtgcagaccaggacgcagaaagcgcctacacagagccctacaaagtctgtcccatctcgtcggcagcccccaaagaggaccttacgtcggatgaagagcagagaagctcggaggaggaggacagtgcttcaagagaccccagtgtcacccacaaggatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttccttgcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagggtgcactgagcctcatctccaaagtcacagaccgtgccaacgacagcatggagcaaggggaaaacctgcagaagctggtccacattgagcacagcgtccggggccaaggggatctcctccagccaggaagggagtttctgaaggaagggacgctgatgaaagtaacagggaaaaacagacggccccggcacctatttctgatgaacgatgtgctcctgtacacctatccccagaaggatgggaagtaccggctgaagaacacattggctgtggccaacatgaaggtcagccgccctgtgatggagaaagtgccctacgctctaaagattgagacttccgagtcctgcctgatgctgtctgcgagctcctgtgcagagagggacgagtggtatggctgtctgagcagagccctccctgaggactacaaggcccaggcgctggctgcattccaccatagcgtggagatacgagagaggctgggggttagccttggggagaggccccccaccctggtgcctgtcacacacgtcatgatgtgcatgaactgcggctgcgacttctccctcaccctgcggcgtcatcactgtcacgcctgtggcaagatcgtgtgccggaactgttcgcggaacaagtacccgctgaagtacctgaaggacaggatggccaaggtctgcgacggctgcttcggggagctgaagaagcggggcagggctgtcccgggcctgatgagagagcggcctgtgagcatgagcttcccgctgtcttcaccccgcttctcgggcagtgccttttcatccgtcttccagagcattaacccctcgaccttcaagaagcagaagaaagtcccttcagccctgacagaggtggctgcctctggagagggctctgccatcagtggctatctcagccggtgtaagaggggcaagcggcactggaagaagctctggtttgtcatcaaaggcaaagttctctacacctacatggccagtgaggacaaagtggccttggagagtatgcctctgctaggcttcaccattgctccagaaaaggaagagggcagcagtgaagtaggacctatttttcacctttaccacaagaaaaccctattttatagcttcaaagcagaagataccaattcagctcagaggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgcagtgagttaaaatttagtaagatgaagatgtggaaaccaatgaaaagtacatttagaaatgcaggctttttagtagaaagaagctcttacagtttttactcatgataaatcttatcacctttcaaaaattgattgtggtgcctcaggtgaaatgagaagctatcagtaacagctactctcatcgaaagcactttattattttacggagctgcaacctccaattttgtgttttctaagtgatttacttaagtcaataacagatggaatcctgtggactaatgtgccaccagttttctaacaagggtgtacataaaatggatttgtgcagacctggctgtggcttgctggtgtgcaagcacacatcactttagaggggctgcgccccaccagataggaaggggaggattttctcctccagtcgaccttgtgacctgtatactaacataacttattaaaggaggggtccctcctcccccagagcagtcctcaacactatgtcagtgctggaaatgcagccactggcagatctggccccccagacgtcaccgcagggcctctgaagagtcaaggtctgctttaatttattgtgtgcctttctgtgtttacctcactcaagctgacaacattgtttatgggaatctatccttcttttagacacacggtaatccttgggctgtattactgaaggctttttattttttgagaggtgaaaaaaagagaaaacaagttagactccaaaggtgaattcctggtcttggcagatggctctgggaacagcgagggagcacagaagtcgtggcctgaggctgttctatgggcacttggggctaaatcgcctcctgagggtgactgttgcttattctgctggacaggtttttacataaagcaaagggcatgtgaggggtgggattccttgttactcttactgcaataaaaatcaattgtttgatatcctgtccccattctgttgctgccctgtcccctacaaaaaagggaatttgctgacaaactttttgtaaaaagcaccatctctggacttacttgcattaaatattttcaggggaatttttttttccagtttgcagttcttttaaaatgtttgcattaaacatgtaactaatggttca

SEQ ID NO: 736789 - DNA, 502 bp, Homo sapiens
aacatttacaccattgagcaacctttcctagacagtgtctccttccttgaagatgctatcctctgaaataactgtgagtacagtcgcataaccctaatttaagatgtgcctgctgaacatgtgctctctcagatcctgtcctcagaatgcttttggctcttttctcggtatctcatccttagagtttttattttataccaatgttctggattacatacctggtccagaaatctagacttgtacttctttttaattgcctagttgacatttcaaccttgattaaagattgacaatatttatcaccttttcctcctggaacaatttaggttaatggtgcagccttttttcctagtcaaacatgccaggaagttcagggcaaagttcaactgctccctcttgtcttatgtggtcactgcttctgagaacatccaggaagttctttctatacttgaatcatcttctcagtcctttggggctttactgctatgagtatgaacttttg

SEQ ID NO: 736790 - DNA, 5044 bp, Homo sapiens
gatattgatggcaggtctaggcttcattgttaggtagaagattgaatacttctcactttatacaaatttacattggctattgctcccatgtgttagctagtcttaacatgtttgttatttcgttatcttattagctgacatacggagtggtattattagtgtcgtactccttagcgtgagcatgacaattaagttaccttactaacagtgatgagtaaaccatactctgatctaaacccattgttaccaatgatgtgattatgaagttagctgaatctatggtctacatttgaagaaatagttcagaattctctactacattgtaagttacttgctaatagagattgggcattattatgtactactccccttctcacatcctacccaaagtacacaaggccgtagtaaaatactgttgctactaaaaactaaacatactgtggttgctaatgtcctttacatcttcagcctatagggaatggtacaggcagaaacaagcaccattaagtatattatcatcagtagtgagatctgtatgattaggatatctttgcttaagcccccaaaggaaaaattctctagcattaaaaacatggctggaacatagctaagcagttaacctaattagtagacttattgttaacgttcagtcctaaaaatgaaaagcttcagttgggagtagaaaatatactatgctggtatatagagcaacaaataccctgatgagataaaatgaagtagaaacttaccatttgacattatttgactttcatacatgctactgaaaagtctaggtttagctaagaagcataaataatggcagtacttgtagaggaaagaacataccagctaaaacaagaactgtaatgaatataatggaaagtgtttggagcttgaatacttggcttcaaaaatctggctttgccatttactgttaaaaaaatatctgagaatttatctcaggctgtaaaacagagaagtcataccaatttcaagaataaaatatgatataaagaattgttgaagccaaaatatccagaaataaacagaatggaaggtatcattgctataattatcttttcagaataaaaaatagagtattctttatcctttctgttgtctcacatgacaagcatgggatggtgaggaaatggcatattgcctatgttcgccgccccacccccttagttccaccaccccttcaccgtcacccccagttcactagtgtatcagaatgcatcttcagaattacacactgaagatacaaaaggtccagttggtaagctcatcagtaaataacaaggctttgaaatctgacaaattagctatttttgtaggaagataatagaacagcaagatggaagacaagtgatgagtatcatctgttttgaggttgacaaggtgtgacataaccctgttaatagacacaagtaaaagaaaatcatactaggattggatattagtgagcgagcaccgaccagtagaaacaacaacagcataaatctgttatttaagtatcccaataatgaggttaaaaaaaaaaaaaaacagaacaaagcatgaaaagaccacaattagtgctggctatgcttagagaggagcagtctcttggtaaactcaggcagtgatgatgaacagaaaatggccgactgatactgtaatagaggcatagaactaaggacactccgtgagctggcataaatacaggggagtctttaagactgaaaaaagttcatgggtatgacacttaatatgactcaacattactgcagaattttaaagcaaacatgaaagcttgagaataaacactagtccctctacttcaagaaaaagcagaacctgtactagaacatgaagaacttagagatcaaaagacagccagaactatgatgaaatattttgaaagcagtgggcacatttttaaagattttttttggagaactttatgaggctgtatgtataattcctatatgtaattttataggaattcttaactgaaagtagttatcaactgctacttatcaggagcagtgttattagggattttaagttaggcatgtagaaaactttctgacaaaagggctattgaactccagccagttcccagtgaatctccaggaggcaccttagaagtcttcacaagctgaataccatgtctttagggtgtccaaatgcttctgtcttgggggagagatgagagatgactgggtgcctttccactcagaacacagtagaccactcactatttatgaccaagcctcacttcttttctattacagttacagattcttttttagtctggaagttagggtaaataaaatttgtatgtttgatttttctcttaggaatgttttctcatcttaactcttatgttatctttatggccaacagatttgctcagaatatatcatcaaaatatatgtattgtattttgtaaaggtgaaaggatcgaaataccactttgacagttataaaccagagtagatttgagaactgattgctcacatcacacttacgaatagtctcagaagcctttaagagaaacttacttctcaatggacacttagaagaatttgatgatcttactgtcataaaatcagtaatgaaattctcagcaaaactatttggtaaacattgcaccctgtatttttacccaacatcttgttatgaaaattatcaaatacattaaaaagttaaaataattttatagtgtactcactacctagatgctaattagcattacctatgcttgctttgtcacatatccattcatcatttcatattattatttgatgcattttaaattgcatatcattaactagagttcattgttggcttttttacataaaattagcatgcaatgaagtgcatagaaatatgtgttcactgaggtttggcaaatgcatatagtgctatggaaataggaaacgttatcaccaccctagaaagtttccacactgccctttccagtcaattcctgtccctacttgaccctcaaaggcaaccactgttcctttttctaccataagatttttctgttctaaaactttatataaatagagtcacgcaacatgtacgcttttctacaaggcttcatttttttattgctgttcttttttattgctgagtagtattccactgtatgacaatattacagtttgttttcttaatttcctattattgatagatacctgggctgtttccaggattggccattataaataaagctgctatgaccattcttacgtaagtctttgtgaacataggttttcatttctttgcagtaaattccttggattagaattgctgggtcacagggtagttttaaaagaaactgccatacctttttccagttcagttttattgtgccctgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccacccgttttcagtaggtaaagtaagactgatcattgaacagaaaaggttatttctgtgatgaggttgagggggtagtggaaagcatgtattgctagtaagccccaggtacagctatgtgagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatccactcttttacctctcccagctgttctattacatacagcattcacctgtattagtctatagaattataatcatctgtgtgtttctaatgctcattttcaaaaatatgtatggtttattcgatttttcctattaaaattttaagggctgggaaatttggcttctactgtaaatccttataatgttccacacattgtaaatatgcaataaaaatgttaacaactataatggcagcaggttttggtatgtatttctttgatatattgtcactttggacaataagtttgatttctgttaataaaagttgttcataaaatctagggagaattaagtcacactggtctctataagataatctgatgaattctgcatctttgaatcaatttgagttattttttgtaaaggtttaaattgtttctaacagtgttacctaaaacctttcattaaatcaaaaatgtaacttgtatattctgaaataacctggagtcttagaagacagaggcttctgcttccctctcccgtgaccccaacaatcccttcccacaggcttggcacagaagttcagtgctttctctacgtctcatgttgtcagaaataggttctcaccataatagacagtggtgaaatttccattgttcctactgagaagtccatttttaaggcatcaaaggtgaatgtgtatttagggatggaggaggcatattacaacaaagctgtatttaaaataacacaatcatatcatgctataaacaatagcagttccagaatggctactaaggattttggactgccagactttggaaattggcaagccttataccttgtccaatgaagttaagtacatttgagtgacagttcaacatacaagcaaaaaaatatatagaagacattgtacatttgttattaatggacatgtttactttacatgttagagtatccatccatctctaggttttccattagatgcttcattgtatccacaaacctgtttcaaaccattgaagtgatcttaccattgtgtttgttcaaaataaaattgggagaaaatgtgaatgagtcaata

SEQ ID NO: 736791 - DNA, 4990 bp, Homo sapiens
gatattgatggcaggtctaggcttcattgttaggtagaagattgaatacttctcactttatacaaatttacattggctattgctcccatgtgttagctagtcttaacatgtttgttatttcgttatcttattagctgacatacggagtggtattattagtgtcgtactccttagcgtgagcatgacaattaagttaccttactaacagtgatgagtaaaccatactctgatctaaacccattgttaccaatgatgtgattatgaagttagctgaatctatggtctacatttgaagaaatagttcagaattctctactacattgtaagttacttgctaatagagattgggcattattatgtactactccccttctcacatcctacccaaagtacacaaggccgtagtaaaatactgttgctactaaaaactaaacatactgtggttgctaatgtcctttacatcttcagcctatagggaatggtacaggcagaaacaagcaccattaagtatattatcatcagtagtgagatctgtatgattaggatatctttgcttaagcccccaaaggaaaaattctctagcattaaaaacatggctggaacatagctaagcagttaacctaattagtagacttattgttaacgttcagtcctaaaaatgaaaagcttcagttgggagtagaaaatatactatgctggtatatagagcaacaaataccctgatgagataaaatgaagtagaaacttaccatttgacattatttgactttcatacatgctactgaaaagtctaggtttagctaagaagcataaataatggcagtacttgtagaggaaagaacataccagctaaaacaagaactgtaatgaatataatggaaagtgtttggagcttgaatacttggcttcaaaaatctggctttgccatttactgttaaaaaaatatctgagaatttatctcaggctgtaaaacagagaagtcataccaatttcaagaataaaatatgatataaagaattgttgaagccaaaatatccagaaataaacagaatggaaggtatcattgctataattatcttttcagaataaaaaatagagtattctttatcctttctgttgtctcacatgacaagcatgggatggtgaggaaatggcatattgcctatgttcgccgccccacccccttagttccaccaccccttcaccgtcacccccagttcactagtgtatcagaatgcatcttcagaattacacactgaagatacaaaaggtccagttggtaagctcatcagtaaataacaaggctttgaaatctgacaaattagctatttttgtaggaagataatagaacagcaagatggaagacaagtgatgagtatcatctgttttgaggttgacaaggtgtgacataaccctgttaatagacacaagtaaaagaaaatcatactaggattggatattagtgagcgagcaccgaccagtagaaacaacaacagcataaatctgttatttaagtatcccaataatgaggttaaaaaaaaaaaaaaacagaacaaagcatgaaaagaccacaattagtgctggctatgcttagagaggagcagtctcttggtaaactcaggcagtgatgatgaacagaaaatggccgactgatactgtaatagaggcatagaactaaggacactccgtgagctggcataaatacaggggagtctttaagactgaaaaaagttcatgggtatgacacttaatatgactcaacattactgcagaattttaaagcaaacatgaaagcttgagaataaacactagtccctctacttcaagaaaaagcagaacctgtactagaacatgaagaacttagagatcaaaagacagccagaactatgatgaaatattttgaaagcagtgggcacatttttaaagattttttttggagaactttatgaggctgtatgtataattcctatatgtaattttataggaattcttaactgaaagtagttatcaactgctacttatcaggagcagtgttattagggattttaagttaggcatgtagaaaactttctgacaaaagggctattgaactccagccagttcccagtgaatctccaggaggcaccttagaagtcttcacaagctgaataccatgtctttagggtgtccaaatgcttctgtcttgggggagagatgagagatgactgggtgcctttccactcagaacacagtagaccactcactatttatgaccaagcctcacttcttttctattacagttacagattcttttttagtctggaagttagggtaaataaaatttgtatgtttgatttttctcttaggaatgttttctcatcttaactcttatgttatctttatggccaacagatttgctcagaatatatcatcaaaatatatgtattgtattttgtaaaggtgaaaggatcgaaataccactttgacagttataaaccagagtagatttgagaactgattgctcacatcacacttacgaatagtctcagaagcctttaagagaaacttacttctcaatggacacttagaagaatttgatgatcttactgtcataaaatcagtaatgaaattctcagcaaaactatttggtaaacattgcaccctgtatttttacccaacatcttgttatgaaaattatcaaatacattaaaaagttaaaataattttatagtgtactcactacctagatgctaattagcattacctatgcttgctttgtcacatatccattcatcatttcatattattatttgatgcattttaaattgcatatcattaactagagttcattgttggcttttttacataaaattagcatgcaatgaagtgcatagaaatatgtgttcactgaggtttggcaaatgcatatagtgctatggaaataggaaacgttatcaccaccctagaaagtttccacactgccctttccagtcaattcctgtccctacttgaccctcaaaggcaaccactgttcctttttctaccataagatttttctgttctaaaactttatataaatagagtcacgcaacatgtacgcttttctacaaggcttcatttttttattgctgttcttttttattgctgagtagtattccactgtatgacaatattacagtttgttttcttaatttcctattattgatagatacctgggctgtttccaggattggccattataaataaagctgctatgaccattcttacgtaagtctttgtgaacataggttttcatttctttgcagtaaattccttggattagaattgctgggtcacagggtagttttaaaagaaactgccatacctttttccagttcagttttattgtgccctgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccacccgttttcagtaggtaaagtaagactgatcattgaacagaaaaggttatttctgtgatgaggttgagggggtagtggaaagcatgtattgctagtaagccccaggtacagctatgtgagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatccactcttttacctctcccagctgttctattacatacagcattcacctgtattagtctatagaattataatcatctgtgtgtttctaatgctcattttcaaaaatatgtatggtttattcgatttttcctattaaaattttaagggctgggaaatttggcttctactgtaaatccttataatgttccacacattgtaaatatgcaataaaaatgttaacaactataatggcagcaggttttggtatgtatttctttgatatattgtcactttggacaataagtttgatttctgttaataaaagttgttcataaaatctagggagaattaagtcacactggtctctataagataatctgatgaattctgcatctttgaatcaatttgagttattttttgtaaaggtttaaattgtttctaacagtgttacctaaaacctttcattaaatcaaaaatgtaacttgtatattctgaaataacctggagtcttagaagacagaggcttctgcttccctctcccgtgaccccaacaatcccttcccacaggcttggcacagaagttcagtgctttctctacgtctcatgttgtcagaaataggttctcaccataatagacagtggtgaaatttccattgttcctactgagaagtccatttttaaggcatcaaaggtgaatgtgtatttagggatggaggaggcatattacaacaaagctgtatttaaggattttggactgccagactttggaaattggcaagccttataccttgtccaatgaagttaagtacatttgagtgacagttcaacatacaagcaaaaaaatatatagaagacattgtacatttgttattaatggacatgtttactttacatgttagagtatccatccatctctaggttttccattagatgcttcattgtatccacaaacctgtttcaaaccattgaagtgatcttaccattgtgtttgttcaaaataaaattgggagaaaatgtgaatgagtcaata

SEQ ID NO: 736792 - DNA, 4172 bp, Homo sapiens
gatattgatggcaggtctaggcttcattgttaggtagaagattgaatacttctcactttatacaaatttacattggctattgctcccatgtgttagctagtcttaacatgtttgttatttcgttatcttattagctgacatacggagtggtattattagtgtcgtactccttagcgtgagcatgacaattaagttaccttactaacagtgatgagtaaaccatactctgatctaaacccattgttaccaatgatgtgattatgaagttagctgaatctatggtctacatttgaagaaatagttcagaattctctactacattgtaagttacttgctaatagagattgggcattattatgtactactccccttctcacatcctacccaaagtacacaaggccgtagtaaaatactgttgctactaaaaactaaacatactgtggttgctaatgtcctttacatcttcagcctatagggaatggtacaggcagaaacaagcaccattaagtatattatcatcagtagtgagatctgtatgattaggatatctttgcttaagcccccaaaggaaaaattctctagcattaaaaacatggctggaacatagctaagcagttaacctaattagtagacttattgttaacgttcagtcctaaaagttaaaaaaaaaaaaaaacagaacaaagcatgaaaagaccacaattagtgctggctatgcttagagaggagcagtctcttggtaaactcaggcagtgatgatgaacagaaaatggccgactgatactgtaatagaggcatagaactaaggacactccgtgagctggcataaatacaggggagtctttaagactgaaaaaagttcatgggtatgacacttaatatgactcaacattactgcagaattttaaagcaaacatgaaagcttgagaataaacactagtccctctacttcaagaaaaagcagaacctgtactagaacatgaagaacttagagatcaaaagacagccagaactatgatgaaatattttgaaagcagtgggcacatttttaaagattttttttggagaactttatgaggctgtatgtataattcctatatgtaattttataggaattcttaactgaaagtagttatcaactgctacttatcaggagcagtgttattagggattttaagttaggcatgtagaaaactttctgacaaaagggctattgaactccagccagttcccagtgaatctccaggaggcaccttagaagtcttcacaagctgaataccatgtctttagggtgtccaaatgcttctgtcttgggggagagatgagagatgactgggtgcctttccactcagaacacagtagaccactcactatttatgaccaagcctcacttcttttctattacagttacagattcttttttagtctggaagttagggtaaataaaatttgtatgtttgatttttctcttaggaatgttttctcatcttaactcttatgttatctttatggccaacagatttgctcagaatatatcatcaaaatatatgtattgtattttgtaaaggtgaaaggatcgaaataccactttgacagttataaaccagagtagatttgagaactgattgctcacatcacacttacgaatagtctcagaagcctttaagagaaacttacttctcaatggacacttagaagaatttgatgatcttactgtcataaaatcagtaatgaaattctcagcaaaactatttggtaaacattgcaccctgtatttttacccaacatcttgttatgaaaattatcaaatacattaaaaagttaaaataattttatagtgtactcactacctagatgctaattagcattacctatgcttgctttgtcacatatccattcatcatttcatattattatttgatgcattttaaattgcatatcattaactagagttcattgttggcttttttacataaaattagcatgcaatgaagtgcatagaaatatgtgttcactgaggtttggcaaatgcatatagtgctatggaaataggaaacgttatcaccaccctagaaagtttccacactgccctttccagtcaattcctgtccctacttgaccctcaaaggcaaccactgttcctttttctaccataagatttttctgttctaaaactttatataaatagagtcacgcaacatgtacgcttttctacaaggcttcatttttttattgctgttcttttttattgctgagtagtattccactgtatgacaatattacagtttgttttcttaatttcctattattgatagatacctgggctgtttccaggattggccattataaataaagctgctatgaccattcttacgtaagtctttgtgaacataggttttcatttctttgcagtaaattccttggattagaattgctgggtcacagggtagttttaaaagaaactgccatacctttttccagttcagttttattgtgccctgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccacccgttttcagtaggtaaagtaagactgatcattgaacagaaaaggttatttctgtgatgaggttgagggggtagtggaaagcatgtattgctagtaagccccaggtacagctatgtgagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatccactcttttacctctcccagctgttctattacatacagcattcacctgtattagtctatagaattataatcatctgtgtgtttctaatgctcattttcaaaaatatgtatggtttattcgatttttcctattaaaattttaagggctgggaaatttggcttctactgtaaatccttataatgttccacacattgtaaatatgcaataaaaatgttaacaactataatggcagcaggttttggtatgtatttctttgatatattgtcactttggacaataagtttgatttctgttaataaaagttgttcataaaatctagggagaattaagtcacactggtctctataagataatctgatgaattctgcatctttgaatcaatttgagttattttttgtaaaggtttaaattgtttctaacagtgttacctaaaacctttcattaaatcaaaaatgtaacttgtatattctgaaataacctggagtcttagaagacagaggcttctgcttccctctcccgtgaccccaacaatcccttcccacaggcttggcacagaagttcagtgctttctctacgtctcatgttgtcagaaataggttctcaccataatagacagtggtgaaatttccattgttcctactgagaagtccatttttaaggcatcaaaggtgaatgtgtatttagggatggaggaggcatattacaacaaagctgtatttaaaataacacaatcatatcatgctataaacaatagcagttccagaatggctactaaggattttggactgccagactttggaaattggcaagccttataccttgtccaatgaagttaagtacatttgagtgacagttcaacatacaagcaaaaaaatatatagaagacattgtacatttgttattaatggacatgtttactttacatgttagagtatccatccatctctaggttttccattagatgcttcattgtatccacaaacctgtttcaaaccattgaagtgatcttaccattgtgtttgttcaaaataaaattgggagaaaatgtgaatgagtcaata

SEQ ID NO: 736793 - DNA, 3894 bp, Homo sapiens
ctgacaaaatgatgcgtgccagaaaacggggagtatttgatgaccaccccttcaccgtcacccccagttcactagtgtatcagaatgcatcttcagaattacacactgaagatacaaaaggtccagttggtaagctcatcagtaaataacaaggctttgaaatctgacaaattagctatttttgtaggaagataatagaacagcaagatggaagacaagtgatgagtatcatctgttttgaggttgacaaggtgtgacataaccctgttaatagacacaagtaaaagaaaatcatactaggattggatattagtgagcgagcaccgaccagtagaaacaacaacagcataaatctgttatttaagtatcccaataatgaggttaaaaaaaaaaaaaaacagaacaaagcatgaaaagaccacaattagtgctggctatgcttagagaggagcagtctcttggtaaactcaggcagtgatgatgaacagaaaatggccgactgatactgtaatagaggcatagaactaaggacactccgtgagctggcataaatacaggggagtctttaagactgaaaaaagttcatgggtatgacacttaatatgactcaacattactgcagaattttaaagcaaacatgaaagcttgagaataaacactagtccctctacttcaagaaaaagcagaacctgtactagaacatgaagaacttagagatcaaaagacagccagaactatgatgaaatattttgaaagcagtgggcacatttttaaagattttttttggagaactttatgaggctgtatgtataattcctatatgtaattttataggaattcttaactgaaagtagttatcaactgctacttatcaggagcagtgttattagggattttaagttaggcatgtagaaaactttctgacaaaagggctattgaactccagccagttcccagtgaatctccaggaggcaccttagaagtcttcacaagctgaataccatgtctttagggtgtccaaatgcttctgtcttgggggagagatgagagatgactgggtgcctttccactcagaacacagtagaccactcactatttatgaccaagcctcacttcttttctattacagttacagattcttttttagtctggaagttagggtaaataaaatttgtatgtttgatttttctcttaggaatgttttctcatcttaactcttatgttatctttatggccaacagatttgctcagaatatatcatcaaaatatatgtattgtattttgtaaaggtgaaaggatcgaaataccactttgacagttataaaccagagtagatttgagaactgattgctcacatcacacttacgaatagtctcagaagcctttaagagaaacttacttctcaatggacacttagaagaatttgatgatcttactgtcataaaatcagtaatgaaattctcagcaaaactatttggtaaacattgcaccctgtatttttacccaacatcttgttatgaaaattatcaaatacattaaaaagttaaaataattttatagtgtactcactacctagatgctaattagcattacctatgcttgctttgtcacatatccattcatcatttcatattattatttgatgcattttaaattgcatatcattaactagagttcattgttggcttttttacataaaattagcatgcaatgaagtgcatagaaatatgtgttcactgaggtttggcaaatgcatatagtgctatggaaataggaaacgttatcaccaccctagaaagtttccacactgccctttccagtcaattcctgtccctacttgaccctcaaaggcaaccactgttcctttttctaccataagatttttctgttctaaaactttatataaatagagtcacgcaacatgtacgcttttctacaaggcttcatttttttattgctgttcttttttattgctgagtagtattccactgtatgacaatattacagtttgttttcttaatttcctattattgatagatacctgggctgtttccaggattggccattataaataaagctgctatgaccattcttacgtaagtctttgtgaacataggttttcatttctttgcagtaaattccttggattagaattgctgggtcacagggtagttttaaaagaaactgccatacctttttccagttcagttttattgtgccctgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccacccgttttcagtaggtaaagtaagactgatcattgaacagaaaaggttatttctgtgatgaggttgagggggtagtggaaagcatgtattgctagtaagccccaggtacagctatgtgagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatccactcttttacctctcccagctgttctattacatacagcattcacctgtattagtctatagaattataatcatctgtgtgtttctaatgctcattttcaaaaatatgtatggtttattcgatttttcctattaaaattttaagggctgggaaatttggcttctactgtaaatccttataatgttccacacattgtaaatatgcaataaaaatgttaacaactataatggcagcaggttttggtatgtatttctttgatatattgtcactttggacaataagtttgatttctgttaataaaagttgttcataaaatctagggagaattaagtcacactggtctctataagataatctgatgaattctgcatctttgaatcaatttgagttattttttgtaaaggtttaaattgtttctaacagtgttacctaaaacctttcattaaatcaaaaatgtaacttgtatattctgaaataacctggagtcttagaagacagaggcttctgcttccctctcccgtgaccccaacaatcccttcccacaggcttggcacagaagttcagtgctttctctacgtctcatgttgtcagaaataggttctcaccataatagacagtggtgaaatttccattgttcctactgagaagtccatttttaaggcatcaaaggtgaatgtgtatttagggatggaggaggcatattacaacaaagctgtatttaaaataacacaatcatatcatgctataaacaatagcagttccagaatggctactaaggattttggactgccagactttggaaattggcaagccttataccttgtccaatgaagttaagtacatttgagtgacagttcaacatacaagcaaaaaaatatatagaagacattgtacatttgttattaatggacatgtttactttacatgttagagtatccatccatctctaggttttccattagatgcttcattgtatccacaaacctgtttcaaaccattgaagtgatcttaccattgtgtttgttcaaaataaaattgggagaaaatgtgaatgagtcaata

SEQ ID NO: 736794 - DNA, 748 bp, Homo sapiens
  misc_feature (6)..(6): n is a, c, g, or t
  misc_feature (747)..(747): n is a, c, g, or t
ctctcnctcctactctgctgccagcatcggtcccgatccagccctgtcccaggccatggtggctaccaagcaggccatgagccctgaagacaagaagagggctgtcaagtattccatgagccacatagcccagatacctgtcaaacacgactctctgaaggaagaatttgcccagctgtcctgtaacctgaaccagcgcttgagttatctagccaatatgggaggtccttccagcctcgggacaacagtggacatattgcagaaaaagattggcagcctccagaaatctaggctcaaggaggaagaacttgagagaatttggggcaaccaaatagagatgatgaaggatcgctacatcactttggacaaggcggtggagaacctgcagattcgcatggatgagttcaagactctccaggctcaaatcaaaagactggaaatgaacaaggtgaataagagcacgatggaggaggagctgagagagaaagctgacaggagtgccctggcaggcaaggcaagccgcgttgacctggagactgtggccttggagctgaacgagatgattcagggcatactcttcaaggtcacgatccatgaggacagctggaagaaggctatggaggagctcagcaaggacgtgaacaccaagttagtccacagtgatctggatcccttgaagaaagaaatggaagaggtctggaaaatcgtccggaagctgctgattgagggcttaagactggatcctgnc

SEQ ID NO: 736795 - DNA, 566 bp, Homo sapiens; identical to SEQ ID NO: 414243

SEQ ID NO: 736796 - DNA, 750 bp, Homo sapiens; identical to SEQ ID NO: 414245

SEQ ID NO: 736797 - DNA, 3045 bp, Homo sapiens
tgctggcgccagacggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcgccacattgctgtgaggaagcctgggctacatggagaagcccacatgaagaggcccatgtggagaggaactgaggccctgacacttggccccatctgcactaccagctgatagccagcatgagcctgccagccaggccagcacagtggctcacacctgtaatcccagcatttcgggaggccaaggtggccagatcacttgagtccaggagtttaaggctgcaatgagctacgatcgcgccactgcactccagcctgggtgacagtacgagatacaacagatgaacacacttcctgtttatgtgctttagttcctttgtatgtgcattttagaaaagtcagaagtctttggtactttgcagcatgtgtgcattggtacaacttctaggaagggcaatttggcaccatctatcagatttacttatgtgcaaaatgatatgtacaagtttattccagcctgatttgtaatagcaagaagaaatggaactagcctgaatgtccctcaatagagtactggttaagtaagtcatggtatatacccaaaataaaatgtaatgcaattaaaaataaatttaagaagagcaaggaagctttccatatatgggtgtggaataatgtccaaaattgttaagtgaaaaagcaaaattcatatcatggttgagtatgtgctcatttgtataaaaagagggtaaacagaatattccaggaggatatgcaagaaactgttaacattggttgcctttggcagctgaagggcgaggtgagaggagactttccactgaatccccttttacaccttttgaattttgaaccaggtgggtaaataacttagtcaaaataaaataaaataaaataaaataaaataaaattggtggaacaaaaataaaaaggtgacttgatggaaaagaaaggagaaagaaaaggagtaaaagacatagggagctacatatatacattatgtcatacatacatacatgcatagagagatgtttactgctttaatctgggctgtcaccctgactcaccttacggacttccttttgctccctcctcttttgcctcatagagtctgcagaccatacttaaattcccacatctccatgattgaagggaatataaagatgaaactgaagttcacctttttaataggactatatcctccaagatcctagaaagcgttgtgtggccctgattcagatgtctgctttcctatggcaccaaaacaatttttacttggaaaggacactaacatttattgaataaacctcatcccagccaagagcttcttaatctttgtctcattccctcaccaaccttgggagatagactgattgggaactgaagttcaaagaggttgaatggggttacctacctgctaaattctagtcccctcactagtaaatgatgaggttgggccatgaggtctgcctgactccaaagaccttgccctttccaatacttcatgctgcctccataattgagggtggtagaatgcagaacagggagtcatttgtcactgtggtggagaaagagttggtttttgactttgggatttagggatacatatgtcctccttcctccttcccctcctagagcaagagctagaagtgaaagaatagaaggtgatgacaacactgcatatatttcagttttatttcttccgatctactaattaacatttgttgggcagtagccataaacaatcctagccaatgcaaggaaacaccaaatattgtcaagccctcacattggtcataactggaagcaaacatgacatatatggactatataatcagtttgcgtgggctacagcaagatgttgcccaagagcctaggcatgagctggcttcctacggcctccaagcaggaaagaatggagctatacacagtcatctgaatatacagaagtgaaccctgggccagccacattcagccgtaacttccccagactgtttctacaggtgcagtgtgccaatcagaagaaaggtggccaggctcaggagaaaggacaggagagtgactctggcaggcttgctccattgtagagatgagatacaccaagatagtgacttcccagcttttctccccaaagcacccctaatagctgagaagaatctggaggcatagctaccatcacagctacactaaccaccatactttactgtatccttcaggtgtctgtcctagctagttttgtggtctggctccttcagtccctgcaacaagcctgtttattttcattatattgatgaggttatagagcttggacaagttacatgacttttcgaagatcacatagctaataagtgtcaagagtcttattctcaaaaccctggtctgtccaactacaagcctgtgctcctgactccactattctgcttaccctaagcctaaagctgcccacttcaagctcaaatcctcttggaggcttcatgctttaaaaaaaaaaaatccatgcaattttttgcatcctaattaataatatatctgtgtgttttagtgtaaatttttttttttaaattaccaattcagttatttagctttttattccccaaatctttggtaccctaggcagatgtgtcatatttatcctgggctttatgtacctctggtttgagggactcttgaacttcattttaagaaacatggcccaatgagtacacagtcaagtcttcatgtccctgaacactgcattataaaatcagcactccttgttctttgtatatttgtgttatcaaataactatgtgattataatctggcttctcatataccataagtgcagaagagaatcaaaagattgagtacctgattccctaaactgtcaaatttcccgttgtatattaataaaatttgtatcgtttcacaaataaga

SEQ ID NO: 736798 - DNA, 2167 bp, Homo sapiens
tgctggcgccagacggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcggtaggtgctggctctgcctttcctcgccgtgttgctcccgcaccgagccggccacattgctgtgaggaagcctgggctacatggagaagcccacatgaagaggcccatgtggagaggaactgaggccctgacacttggccccatctgcactaccagctgatagccagcatgagcctgccagccagagtctgcagaccatacttaaattcccacatctccatgattgaagggaatataaagatgaaactgaagttcacctttttaataggactatatcctccaagatcctagaaagcgttgtgtggccctgattcagatgtctgctttcctatggcaccaaaacaatttttacttggaaaggacactaacatttattgaataaacctcatcccagccaagagcttcttaatctttgtctcattccctcaccaaccttgggagatagactgattgggaactgaagttcaaagaggttgaatggggttacctacctgctaaattctagtcccctcactagtaaatgatgaggttgggccatgaggtctgcctgactccaaagaccttgccctttccaatacttcatgctgcctccataattgagggtggtagaatgcagaacagggagtcatttgtcactgtggtggagaaagagttggtttttgactttgggatttagggatacatatgtcctccttcctccttcccctcctagagcaagagctagaagtgaaagaatagaaggtgatgacaacactgcatatatttcagttttatttcttccgatctactaattaacatttgttgggcagtagccataaacaatcctagccaatgcaaggaaacaccaaatattgtcaagccctcacattggtcataactggaagcaaacatgacatatatggactatataatcagtttgcgtgggctacagcaagatgttgcccaagagcctaggcatgagctggcttcctacggcctccaagcaggaaagaatggagctatacacagtcatctgaatatacagaagtgaaccctgggccagccacattcagccgtaacttccccagactgtttctacaggtgcagtgtgccaatcagaagaaaggtggccaggctcaggagaaaggacaggagagtgactctggcaggcttgctccattgtagagatgagatacaccaagatagtgacttcccagcttttctccccaaagcacccctaatagctgagaagaatctggaggcatagctaccatcacagctacactaaccaccatactttactgtatccttcaggtgtctgtcctagctagttttgtggtctggctccttcagtccctgcaacaagcctgtttattttcattatattgatgaggttatagagcttggacaagttacatgacttttcgaagatcacatagctaataagtgtcaagagtcttattctcaaaaccctggtctgtccaactacaagcctgtgctcctgactccactattctgcttaccctaagcctaaagctgcccacttcaagctcaaatcctcttggaggcttcatgctttaaaaaaaaaaaatccatgcaattttttgcatcctaattaataatatatctgtgtgttttagtgtaaatttttttttttaaattaccaattcagttatttagctttttattccccaaatctttggtaccctaggcagatgtgtcatatttatcctgggctttatgtacctctggtttgagggactcttgaacttcattttaagaaacatggcccaatgagtacacagtcaagtcttcatgtccctgaacactgcattataaaatcagcactccttgttctttgtatatttgtgttatcaaataactatgtgattataatctggcttctcatataccataagtgcagaagagaatcaaaagattgagtacctgattccctaaactgtcaaatttcccgttgtatattaataaaatttgtatcgtttcacaaataaga

SEQ ID NO: 736799 - DNA, 676 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaacacaaaacaacacacacaccacaaacacttgtgggggccgcctatggggcccctggaaaaaccgcttcaaaacaccaattccgttggggccgccgggggcccaagaaggggaacggtgacccggggccaataggggggtccccagggaaaccggggaccaggacaacgggc

SEQ ID NO: 736800 - DNA, 675 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatgtaagtgaggcggccggatcacagccctcgtgggtggggagcacgtgtgcatcgggatcgtcggaggatttcaaagttggcttaaggagctggccgcttagatgcccactccgtgcatcctggcgcgcatgggagacccgttgtgtgcttagcctcttacctgccttgaccttgcggtccttgtgcctggaatgcatccccggagacccatcttaatgctgccttcaaagcctacccggaccccttccttccgcttcccaccaacacttgagtttttaacccccttggcaggtgggtggcttgcaccctggagtggcagcgtaagttattttacatggctaagagtgcgggagacttgtgaaaggaacatgggtttggagttcatcaacctgggtacaaagtccacttctcaaaaaaaaattagatgggtgtggtggtacag

SEQ ID NO: 736801 - DNA, 638 bp, Homo sapiens
  misc_feature (518)..(518): n is a, c, g, or t
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaatnataataatatttattataatttaacatttaatatatttttacttatatcttttttatatattttatttattttaatttttactaatccccttcttttacaccttccccctcctcttccct

SEQ ID NO: 736802 - DNA, 672 bp, Homo sapiens
tatggctagtacgaggctgggtggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaaaaaaaaaaaaaaacaaaaaaaaaaaaagaaaaccccggagcgacacaaagagagagacgacgcacacaaagaggaacaaagacgcggcaaatagaaaacaagagaccacgacacacaaatctatagcaacaaagggggagaaaccgcggggaacccataaaggggacacaaaaaacgcgaaag

SEQ ID NO: 736803 - DNA, 609 bp, Homo sapiens
  misc_feature (563)..(563): n is a, c, g, or t
  misc_feature (582)..(582): n is a, c, g, or t
  misc_feature (603)..(603): n is a, c, g, or t
ggacgcgtgggtcgcccacgcgtcgggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaacaaaaaaaaaaaaaaaaaaaaaaaaaaaaaaaaggggggggcgcgcgcaaaaaaaattcccccgggggggcccaaatttgncgcgcccccgttttttggnaaaaagggggcccccaataanaggaga

SEQ ID NO: 736804 - DNA, 726 bp, Homo sapiens
  misc_feature (98)..(98): n is a, c, g, or t
  misc_feature (103)..(104): n is a, c, g, or t
  misc_feature (109)..(109): n is a, c, g, or t
  misc_feature (111)..(111): n is a, c, g, or t
cagcacgttcttcctctgaggacctttatataagccccctatacccccagaggaatgcatccagaactttaaacaggctgggtcaacaacaaggggcncggcnnttgcngncttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaacaaaaaaaaaaaaacccctgttgggccgccttggcccaatcgattctttactccgacaaacttttgccttgcggcccgaatttgagcccacttgggccattcgccctataggggggcgtattaaaaatacttggccgccggttaaaacccgtggcggggaaaacacccggggtgccccact

SEQ ID NO: 736805 - DNA, 491 bp, Homo sapiens
taccttgctcctggtgttatcctccggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaatattaacacctactataccatcgttttgccctatagtgagt

SEQ ID NO: 736806 - DNA, 484 bp, Homo sapiens
ggtggcgtctcggcacgagggtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaagtcgacgcggccgcgaatttagtagtagtaggcggccgc

SEQ ID NO: 736807 - DNA, 1008 bp, Homo sapiens
  misc_feature (748)..(748): n is a, c, g, or t
  misc_feature (761)..(761): n is a, c, g, or t
  misc_feature (763)..(763): n is a, c, g, or t
tgagtgacgacagtacaaaagtctggagaaagccccaaagtagtcccctgttcccagagccccaagaataaacagatgggagaacaagaccctcctcttccgtttcccccacagagagatccctgtgacacatctaccgggacccctcgaaatattcctgggaacttcgggaccaaaaagaacatagcgcaccaagagaccccaggttcccaggttattcccccagttgggtaggggacaggcctgctctcggggagggtaccgtgcatcggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaaaaaaaaaaaaaaacaaaaaaaaaaaaaancgggggggttatntntggggggggggaaaaaaggtttaataataaatgggacgtagtgtgaataatagttgcttcgtcgagaaacccactatttttttgggcaccaaggggggagaaacggcggggccaccaaaggaggaggggtaaatctgaaaaccacgtgttcttggtttatctgtccgtcaacaacaattttgctatggaatcaagatatatgcgggagaatacactctattacaaacaatgggtagacacattgt

SEQ ID NO: 736808 - DNA, 623 bp, Homo sapiens
  misc_feature (577)..(577): n is a, c, g, or t
  misc_feature (596)..(596): n is a, c, g, or t
  misc_feature (617)..(617): n is a, c, g, or t
tactaaattcgcggcccgtcgaccggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaacaaaaaaaaaaaaaaaaaaaaaaaaaaaaaaaaacaacaacaaacaaaaacaaacaaagaggggggggcgcgcgcaaaaaaaattcccccgggggggcccaaatttgncgcgcccccgttttttggnaaaaagggggcccccaataanaggaga

SEQ ID NO: 736809 - DNA, 344 bp, Homo sapiens
  misc_feature (15)..(15): n is a, c, g, or t
  misc_feature (22)..(22): n is a, c, g, or t
cgttctgtaggaatncggcacnagggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaagcggtgcggcctccaagctctctaagatccgagtcgtccggaaatccattgcccgtgttctcacagttattaaccagactcagaaagaaaacctcaggaattctacaggggcaagaggacaagccctggccctgggcctaagagacaggcccttgggcgcggttcacagcacgggggacctga

SEQ ID NO: 736810 - DNA, 343 bp, Homo sapiens
tactaaattcgcggcccgtcgaccggcgttggcggcttgtgcagcaatggccaagatcaaggctcgagatcttcgcgggaagaagaaggaggagctgctgaaacagctgaacgacatgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcaaaaagtcgacgcggccgcgaatttagtagtagtaggcggccgc

SEQ ID NO: 736811 - DNA, 735 bp, Homo sapiens
  misc_feature (492)..(492): n is a, c, g, or t
  misc_feature (499)..(499): n is a, c, g, or t
  misc_feature (502)..(502): n is a, c, g, or t
  misc_feature (519)..(519): n is a, c, g, or t
  misc_feature (526)..(526): n is a, c, g, or t
  misc_feature (541)..(541): n is a, c, g, or t
  misc_feature (549)..(549): n is a, c, g, or t
  misc_feature (552)..(553): n is a, c, g, or t
  misc_feature (558)..(558): n is a, c, g, or t
gggtggcgttccaagacgaggggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaacaacaaaaaaggggggggaccggtagccaattcgccctatagngagtcgnatnacaattcactggccgcngttacancgtcgtgactggganaacctggngtnncccanttaatcggactggagaaaatcccgtattggcaggtagagtaataagcacatggccgacagatagcattccagggttgcgcacctaatggcgatggaacttgacggtatatttgggaacacgcgtaaatttgatcgcgatattcacactggcacatcgacaccatgacaccatgtgcg

SEQ ID NO: 736812 - DNA, 766 bp, Homo sapiens
  misc_feature (15)..(15): n is a, c, g, or t
  misc_feature (22)..(22): n is a, c, g, or t
cgttctgtaggaatncggcacnagggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaacaaaaaaaaaaaaaaaaaaaaaaaaaaaaaaaaacaacaccccctcccattcactaacactcccactaatccccctatttccccccttttcctcatcatcttaccttttttttttttttttttgcgggccccttgggccccatgtttttttattttgggagagttttttgttggggcgccaatttgaggtcatttggccaattgccccttatggggagggttaaacaattccggccggtgttttaaaagggggagtggaaaaccccgggggttccccaataaatagcgtggggg

SEQ ID NO: 736813 - DNA, 322 bp, Homo sapiens
caaacgcttgtgaaggatggggctgaggatggggctggggctggggcccaatccttggggctggaaaacctgtggggatcccagaagagaagtggtgctgtgctgggatgggttgcttagcccctgcagggtaggtgtaaggcgtgggcagtggctgcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctctagcggctcccgggaatccgag

SEQ ID NO: 736814 - DNA, 963 bp, Homo sapiens
  misc_feature (322)..(322): n is a, c, g, or t
  misc_feature (324)..(324): n is a, c, g, or t
  misc_feature (948)..(948): n is a, c, g, or t
cggagcttatgtgctttgggacggggtgcggctcctagctctctaagatccgagtcgtccggaaatcattgcccgtgttctcacagttataaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaananaaaaaaaaaaaaaaagggggggccccccatacccttttttataagcccttttaaaaaatttacccttgcaagcttccccgtcccgggggttccccccttcttaaatctcaccaggatcagacgggggacaaagcttcaacgcacaagcagccagggcgaggctcaaaacggtttaagcatagccaaacccccagggggaacaacaacgcagcgtgataaacccgtttggcactaaacccgaaacgttacccaaaggcatattagctaacccccgaggggtgggccaattctgggtgcacagccaccgggggtcaccggatttaaccccagggtcaaatagaacggccgggggaacaacggtgggtgttagatagcccccctccccaaataaaggctaaaagccctcaccctcggagttggtaaaaacacctcccagcgtttgaccccaacaagtaggactaccgacaaagggggtttcacccatcttctggacccccagttagcgtaagaccccaacggggatttagatacccccgtatggttaagccctaaccctgcacggtaattcaccaaaattgtccgccagaaacttacgaccacgttaacccaacggcgcggcgcgtncaatccctaaaggcg

SEQ ID NO: 736815 - DNA, 313 bp, Homo sapiens
acagttattaaccagactcagaaagaaaacctcaggaaattctacaaggtgagtctgcctggacatagggagggttggctgcaggaagccaagtgctagccgtccctggccggggacatggtaaagaggtttttcttggtgcgtgggctgagagtggttagccttcccaatttgttgctgggctcactcttctaccagtgtcttgcactggcacgtggctctgcagaccacttcctcaggctgcagatgtcaagaattcattggggcttggggtgtcctggctggagactcagtttttgaaaccagccttccc

SEQ ID NO: 736816 - DNA, 981 bp, Homo sapiens
tcgagctcggccccggttaatgtagatactgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaacaaaaaaaaaaaaaaaaaaaaaaaaaaaaaaaaaaaaaaaagaaagaaaaaaaaaaccacctcaaatgacgcgcaccaacagccactcacgtgacacgctggtgaccctaaggcacggggcgccgtgcatccctggtgtgagtcaagacgagagtaggaatgaggttgggggaggtgggaaggggagaggctaggggcgcggtgggccgctagcgagaccgtatcgtgggtgcaggtggggtagggtggagagagcagcgagcgcccgtcagaagaagagacgcgcgcagcaggagcgcacggctgaagattagtagacggtcgcatattgacaaaatggagttgatttgcctgagcatgagttctgcagcgctgtgcgtcgttgtgagaacaggacacgagcggttattatagatatataagatgtataagaccgatcgattgcattgcgtctcatgctcgagctacacagcctcgtactcttgtagggaggcggagtaggagggaggaggggttgctgtgcgtcgtattgcacaggtgctcggtcgtgtcgagctggggggatgaggagtgagagtggaaggatcggagttgcggcagggagagagaggtgggtaggaggtggtgggagggagggtggaggaggtgggcctgggggggagctaggtgaagctagaagcaggggcgagacggt

SEQ ID NO: 736817 - DNA, 487 bp, Homo sapiens
aagagcccattccagagccgcagctgacaacggagagtccagaatctactctaagttctgagttcactttagagccagggccccagaaaacaccagagtcagcagggagctttgtgcccctctcgaggcagagcccagagcccggggctctttttacaggcagagcttagaacctagagctgctctggagctggggcccggcactggagctgagaacctacttcgatccttcttgggttagcaaagtctactctggactcaatgtcctgagccactgcccagagaacattctggaacccccactacacagaaccaggaaccactctgcatccaaagccgggagtctgggcagagcccgctggacctcacctccccgccgtgctggccgaagaatttcactctccgcacggccagcgtggccgggaccccgctgttcatgggcacccggccccgccccgccccggcgggctccctcctaggcggccgc

SEQ ID NO: 736818 - DNA, 891 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaacaaaaaaaaaaaaaaaaaaaaaaaaaaaaaaaaaaaaaaaaaaaaaaaaaaaaaaaaaaaaaaaaaacaaaaaaaaaaaaaagggcgggagaggaggagagagggaagggggggagggacggagagaggggaaagacaagacgggaaggcgcggagagggagggaacgcaaggggggggacggagggggaagaggcgagaaaagagaaaaagagagcaggagaaaagcaaaagagaacagaaaaaaagacgcgagaggaaagagggagaacagagcgcaaagagaaaaaacacaacaaacgacggcagaagggagaaagacacagagaaaaaaagaacagcaaaaaaaagaaggagagagacagaaaagcaccac

SEQ ID NO: 736819 - DNA, 811 bp, Homo sapiens
  misc_feature (551)..(551): n is a, c, g, or t
  misc_feature (564)..(564): n is a, c, g, or t
  misc_feature (566)..(566): n is a, c, g, or t
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaacaaaaaaaaaaaaaaaaaaaaaaaaaaaaaaaaancgggggggttatntntggggggggggaaaaaaggtttaataataaatgggacgtagtgtgaataatagttgcttcgtcgagaaacccactatttttttgggcaccaaggggggagaaacggcggggccaccaaaggaggaggggtaaatctgaaaaccacgtgttcttggtttatctgtccgtcaacaacaattttgctatggaatcaagatatatgcgggagaatacactctattacaaacaatgggtagacacattgt

SEQ ID NO: 736820 - DNA, 743 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaacaaaaaaaaaaaaaaaaaaaaaaaaaaaaaaaaaacccgcgagagagcctatctattggcgcggggcgggagaaaaaagagaggacaagaaaggggcgaagagggcgccaaagggtggtccccggagaccccattttctttgggcacaaggggggaaaacttcggcggggccccccaaaaagagagggcgtaatattccgaaaaccccggggaaacccggttaaggt

SEQ ID NO: 736821 - DNA, 857 bp, Homo sapiens
  misc_feature (552)..(552): n is a, c, g, or t
  misc_feature (554)..(554): n is a, c, g, or t
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaacaaaaaaaaaaaaaaaaaaaaaaaaaaaaaaaaaananaaaaaaaaaaaaaaagggggggggggggcataaaataattccccgggggggggcaatttgggcccctttttttagaaaaaggggggcccacataatgaggggggagcgtatattaaaaacacagaagcggcgggcgcgggttaaacaacacgctggtggagagaaaaatggttgcaggcgatttaggaagaaaacccatttcgggggggggaatatgggaccacaactagaaatatacgtgaggagaaaatactaggagagagtggacccgtattttcgggaaactgtaggtatagtaattag

SEQ ID NO: 736822 - DNA, 817 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaaaaaaaaaaaaaaacaaaaaaaaaaaaacaaaaaccgcggggccaatatggggggggggggaaacaaggggtaaaaatgggcatggggctgaacggggcgttccggaggacccgagttctttgttgaccaaggggcgggaaacctgggggggcaccccaaatgggagggggacgccaaaaatgtggcataaaccgcccggggaagcccgctttaaagactctggccggcaagaaccggaatcctggagtacgatgcatgatcttggagcacaggggcacttagactgtagac

SEQ ID NO: 736823 - DNA, 907 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaaaaaaaaaaaaaaacaaaaaaaaaaaaaccccggggccttttttgcgcagggggggagaaacacgagggtcattaaattggcgagcattggcacaaagtggttcccaggaacccacgtttttttgtgccacaggtgggagaaacagacggggccccccaataaagagggagcgcccaaaataatatgcgaaaagcgacgggttacctgtagaattcagtgggcaatgaaaattcggcgagaaataacaccgcagaaatgcgcagaggctaattaggaagcacacaaaagatctctcaaagcagctttgcgcgagagaactcgtggttctaaaaaacaaccgaacccagcgggtgttttcgcgcaaagacacacacttctcgc

SEQ ID NO: 736824 - DNA, 1024 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaacaaaccaaacaacaaacaaaaaaaaaagacgaggggggggcgcgcctcaaagaagatatcccgcgcgcgaggggggcgcccagagtttagcagcgcgtcacgccgaggttttgcgtgtggaacagaggggggcgccccaaagagaggagagagcgcgcgaaataaagaagagccgaaagagcaccgtgggccgcagcagttgataaacacaacgacctgggagacgtggggaaaacacggtgcgaaccaggggcgaacccgtgggagaagaggaacccttaactcggggggggcgggcgaaccatatagggggggggcacaaaagattacactctaagcggaaggattttgaagagggcgccacaaaggggggaaacattatttatcaaattttagagaggggggtataacagcggggggtttaaaaccacatggagcggatattatggtatagggaggagagtaaaaaaagtgtggcgataacaggggaggaatatgcacaatggcacacattcttt

SEQ ID NO: 736825 - DNA, 673 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaatcgacccctttggccacattaatttagactccgccaaggctaaccaaggcggcccatttccacaaaacttgtttcgcccaattttgggcggggcccaaatacgggccattgtgccaatgccctattggggaacctttcaatccccggccgagttttcggccgcccggc

SEQ ID NO: 736826 - DNA, 680 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaccactctacctctcttttctctcctcacacctctatcatcccttccccctcaatccaccatcctggggttttacacaattcccctaatcataacaattgttgtctccctctggccacccttattttacctccgccactctttcctttgggccgccatttggggcctttctgctcc

SEQ ID NO: 736827 - DNA, 718 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaccaaacccaacacaacaacaagcaagaaacaaacacccagagtcaatagaggccgagcaagctttcatgggcggatcaagctcttgtgcaatcgccttgggagcgatacaatcagtgcgagtacaacgtcggactggaacctgggtacaataacgctgcagaatccctttgcgcgggtatcaaaggcgagaggccttcaagttgcactaagaa

SEQ ID NO: 736828 - DNA, 609 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaatataataactttatttgtgttttacctacctctgtaaataaatatactatttttttttttccttgggggggggcccgtcccacaattccccttattgggttgtt

SEQ ID NO: 736829 - DNA, 727 bp, Homo sapiens
  misc_feature (507)..(507): n is a, c, g, or t
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaanaaaaaaatctggtcaagtggagatttttaagaacttcctttttaagttgtaaaccttttattacaaatttaacacatgaagttcttaaaaatctcaattgaccagattatgacacagtttaacaacttcatttgtaattctgtactaacaagtttacaacctggattttttgcacaccaagtcaacaaatctgcaagccacctgttaatacggtcttaac

SEQ ID NO: 736830 - DNA, 552 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaccatttcccggcaactcttattttgcctttgtcgcttttcttgt

SEQ ID NO: 736831 - DNA, 788 bp, Homo sapiens
  misc_feature (563)..(563): n is a, c, g, or t
  misc_feature (570)..(570): n is a, c, g, or t
  misc_feature (573)..(573): n is a, c, g, or t
  misc_feature (590)..(590): n is a, c, g, or t
  misc_feature (597)..(597): n is a, c, g, or t
  misc_feature (612)..(612): n is a, c, g, or t
  misc_feature (620)..(620): n is a, c, g, or t
  misc_feature (623)..(624): n is a, c, g, or t
  misc_feature (629)..(629): n is a, c, g, or t
  misc_feature (709)..(709): n is a, c, g, or t
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaagcaagcttatgcatgcggccgcaattcgagctcacttggccaattcgccctatagngagtcgnatnacaattcactggccgcngttacancgtcgtgactggganaacctggngtnncccanttaatcgccttgcacacatcccctttcgcaggtggggaataaacaaaaggccccccccaacgccttcccaacattgccancctgatggcaatgaaattgaagcgtatattttgtaaattcgcgtaaattttgtactatttttaccaatgccgtcggccc

SEQ ID NO: 736832 - DNA, 597 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaagcagcagcggaaggagcggctgtacccgctgcggaagtacgcggtcaaggcctgaggggcgcattgtcaataaagcacagctggctgagaaa

SEQ ID NO: 736833 - DNA, 2142 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggccctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagactgctttgtttcctggcacttccactgattgggtggaggtgggtgggtctggttttggggaccaggtgtctgatgggttccagcaagcgtcctgcccaccacagttgtctgctctggtggggcctggagagtcctggccatggggatctgctggatgccagcacagtcactttgcgtctgtggggagaagcggcatgcctgtgcgccactgaggggagcgggtgaggtcggcaccatctgaggtggttggtgttaggtttgagggtccctgggtgatttggacgtgcgggatatttgacgtctagtctgatcggcagctccagacactaagattttcccatctggggtgaaggcacaggtgtgggccacatccaggactccctgcttcagggtctcaaggcactttcctgtgttgcagtcccagactttgaccatgcgggaatagccggcgctggccagccacagctcgtcgggagagaaggctatgctcttcacccaggtgacatggcccttcagttggataagcaggctgctggttgtgggcttccagatgtggatggtcttgtcccaggagccggatgccaggaggccggatgctgaatagcacaggcagctgatgttgccactgtgtccctctagcgcctggtgggagactgctggggtcaccatccgcaggtcccagatgctgtacggtggagtcccaggagccggtggccaggcagttcaccgtgggtgagaagtcgctgctctggatggagtcacggtgcccaactaagaggcgcagcatctggccggactagagagagccctgagctgcagaaggcagcagagggcagccggctacctggccttgacagtccaggaaagggggacctcgtgcaaaaagcctgagggctgctgtgtgcaaggaagcctggagaggcggctgtggccaggtgggggcagccttggttgcctgctgtgggcatgggccatgggaaccagtggagggtttgagctgggagggcaagactggtgacatcctctctggaactggtccttgaatcccagactggtggccccagcccctcaacgtacctgcacatcccagagcatcacccgcttgtcccagccacctgatgccagctgtctcgagtcagggctgaagctgaccgtctccacactccgttggtgacctgcaggcaccagcccggggtcggggaaggtggaaaggtgacgtgacacaggacacagcaccatctgaaagggaacgctggcctggctgcttggctcccagctcactcacccttcaggacccgcagacacttcgctcttgccacatcccacaggcggacagtgcagtcacaggaggcgctggcgaagaggtggccatcaggggagaagcggcagaacttcacggggcctgtgtggccacccagcctccacagcagctgcccactccgggtctcccagccatacacgcagccatcttctgagcctgtgagcagcatctggccatcaggggagaaggcagaagagttgacctccccgccgtgctggccgaagaatttcactctccgcacggccagcgtggccgggaccccgctgttcatgggcacccggccccgccccgccccggcgggctccctcctaggcggccgc

SEQ ID NO: 736834 - DNA, 2032 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggccctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagactgctttgtttcctggcacttccactgattgggtggaggtgggtgggtctggttttggggaccaggtgtctgatgggttccagcaagcgtcctgcccaccacagttgtctgctctggtggggcctggagagtcctggccatggggatctgctggatgccagcacagtcactttgcgtctgtggggagaagcggcatgcctgtgcgccactgaggggagcgggtgaggtcggcaccatctgaggtggttggtgttaggtttgagggtccctgggtgatttggacgtgcgggatatttgacgtctagtctgatcggcagctccagacactaagattttcccatctggggtgaaggcacaggtgtgggccacatccaggactccctgcttcagggtctcaaggcactttcctgtgttgcagtcccagactttgaccatgcgggaatagccggcgctggccagccacagctcgtcgggagagaaggctatgctcttcacccaggtgacatggcccttcagttggataagcaggctgctggttgtgggcttccagatgtggatggtcttgtcccaggagccggatgccaggaggccggatgctgaatagcacaggcagctgatgttgccactgtgtccctctagcgcctggtgggagactgctggggtcaccatccgcaggtcccagatgctgtacggtggagtcccaggagccggtggccaggcagttcaccgtgggtgagaagtcgctgctctggatggagtcacggtgcccaactaagaggcgcagcatctggccggactagagagagccctgagctgcagaaggcagcagagggcagccggctacctggccttgacagtccaggaaagggggacctcgtgcaaaaagcctgagggctgctgtgtgcaaggaagcctggagaggcggctgtggccaggtgggggcagccttggttgcctgctgtgggcatgggccatgggaaccagtggagggtttgagctgggagggcaagactggtgacatcctctctggaactggtccttgaatcccagactggtggccccagcccctcaacgtacctgcacatcccagagcatcacccgcttgtcccagccacctgatgccagctgtctcgagtcagggctgaagctgaccgtctccacactccgttggtgacccttcaggacccgcagacacttcgctcttgccacatcccacaggcggacagtgcagtcacaggaggcgctggcgaagaggtggccatcaggggagaagcggcagaacttcacggggcctgtgtggccacccagcctccacagcagctgcccactccgggtctcccagccatacacgcagccatcttctgagcctgtgagcagcatctggccatcaggggagaaggcagaagagttgacctccccgccgtgctggccgaagaatttcactctccgcacggccagcgtggccgggaccccgctgttcatgggcacccggccccgccccgccccggcgggctccctcctaggcggccgc

SEQ ID NO: 736835 - DNA, 580 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaaggtgagtctgcctggacatagggagggttggctgcaggaagccaagtgctagccgtccctggccggggacatggtaaagaggtttttcttggtgcgtgggctgagagtggttagccttcccaatttgttgctgggctcactcttctaccagtgtcttgcactggcacgtggctctgcagaccacttcctcaggctgcagatgtcaagaattcattggggcttggggtgtcctggctggagactcagtttttgaaaccagccttccc

SEQ ID NO: 736836 - DNA, 2141 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagactgctttgtttcctggcacttccactgattgggtggaggtgggtgggtctggttttggggaccaggtgtctgatgggttccagcaagcgtcctgcccaccacagttgtctgctctggtggggcctggagagtcctggccatggggatctgctggatgccagcacagtcactttgcgtctgtggggagaagcggcatgcctgtgcgccactgaggggagcgggtgaggtcggcaccatctgaggtggttggtgttaggtttgagggtccctgggtgatttggacgtgcgggatatttgacgtctagtctgatcggcagctccagacactaagattttcccatctggggtgaaggcacaggtgtgggccacatccaggactccctgcttcagggtctcaaggcactttcctgtgttgcagtcccagactttgaccatgcgggaatagccggcgctggccagccacagctcgtcgggagagaaggctatgctcttcacccaggtgacatggcccttcagttggataagcaggctgctggttgtgggcttccagatgtggatggtcttgtcccaggagccggatgccaggaggccggatgctgaatagcacaggcagctgatgttgccactgtgtccctctagcgcctggtgggagactgctggggtcaccatccgcaggtcccagatgctgtacggtggagtcccaggagccggtggccaggcagttcaccgtgggtgagaagtcgctgctctggatggagtcacggtgcccaactaagaggcgcagcatctggccggactagagagagccctgagctgcagaaggcagcagagggcagccggctacctggccttgacagtccaggaaagggggacctcgtgcaaaaagcctgagggctgctgtgtgcaaggaagcctggagaggcggctgtggccaggtgggggcagccttggttgcctgctgtgggcatgggccatgggaaccagtggagggtttgagctgggagggcaagactggtgacatcctctctggaactggtccttgaatcccagactggtggccccagcccctcaacgtacctgcacatcccagagcatcacccgcttgtcccagccacctgatgccagctgtctcgagtcagggctgaagctgaccgtctccacactccgttggtgacctgcaggcaccagcccggggtcggggaaggtggaaaggtgacgtgacacaggacacagcaccatctgaaagggaacgctggcctggctgcttggctcccagctcactcacccttcaggacccgcagacacttcgctcttgccacatcccacaggcggacagtgcagtcacaggaggcgctggcgaagaggtggccatcaggggagaagcggcagaacttcacggggcctgtgtggccacccagcctccacagcagctgcccactccgggtctcccagccatacacgcagccatcttctgagcctgtgagcagcatctggccatcaggggagaaggcagaagagttgacctccccgccgtgctggccgaagaatttcactctccgcacggccagcgtggccgggaccccgctgttcatgggcacccggccccgccccgccccggcgggctccctcctaggcggccgc

SEQ ID NO: 736837 - DNA, 788 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacagggcaagaagtccaagcccctgacctgagtgtttcttctgagtccggaaatccattgcccgtgttctcacagttattaaccagactcagaaagaaaacctcaggaattctacagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaacacaaaacaacacacacaccacaaacacttgtgggggccgcctatggggcccctggaaaaaccgcttcaaaacaccaattccgttggggccgccgggggcccaagaaggggaacggtgacccggggccaataggggggtccccagggaaaccggggaccaggacaacgggc

SEQ ID NO: 736838 - DNA, 1503 bp, Homo sapiens
  misc_feature (1022)..(1022): n is a, c, g, or t
gtggagagatagctgggctcacttcagaagacccaaattttgattcaagactgctttgttctctcaccagaggcaaacatatcaccaggttgcctttgggaggagactgctaacaaccattgagcagacataacctggagatttgttttgcaatgtgttgtataacaatgttgatttaattgcctcaggcgatttcacatgaaaatccaggtagaaaagtggaaaatatagcaacagtgggattggaggtgaatagctgcctccacctgtggatgaggcatgtcctctctttttatcaaactctcatcacctcttttcttatatcctgtctgcttcatttatttatatcatctgcttgcctctgttggtatggcagttagcaacactaatcatctggtttggggaggacggtgctgcacttattttcaccaacaaagggccaggggacgttttgcactcattttttgatagcaggaacacttacaggatcatgaacaccacattggaatcagaggttcctcagtgctactcaaaacttctctgctgcaattccaactctacctccctgggccctcgttagaatcctttgatcatcctcctccagggattgagatcacatgataaacaatcttggattgggtcaggttaagctatatgcaggtatgataaattcataattttcaaactgcggtatgtgtacctaaggcttttcacggattgcatactcaggacaattttcaggaaattaatttccagatcctctatatacactatactctttccttaaattgatctgctgagaatgagtctttgttcatactgtttcttttcccacagaaaaaagatataggctacccatcccaaatcttaatacattgctcttaatgtgacaccaaaaacctcagatgtagcaaacagaggaaaggtttgatgattaatcataaaaccatagagccttgggcttttgcctcttatacacatgttaaagctgattatgatgttagataacatagaaattgggngtttggactcacaaatagattttcagaattcagatgtatgataaagtggagtgatggtaacaattttttttttttaacggctttttggttttctcttcctgactcttgtcaaagaatttcttgctcttgagggaaagcccatgggagagtgaaacaaagaaaattagtagaaggcactgaatgccaaaaatgtcttcttacatataattataatcaattatttcccattattgtcaatatccttccctaggatgtatcttgactgggaaaaaaagtaacttggaagagctaaagcagtatagatttgccatgctgattattttaaatgtaaccagaatggcttttgggaatgccaaatttttataaggtgcagtagacagatagaacccaaggataaaaactttcacatggttctttcagatttgatgtgcattcattaataaagttgtcagaacccattgtatcaaaccataacatgaaa

SEQ ID NO: 736839 - DNA, 2792 bp, Homo sapiens
tgctggtactgccccgggattaacgggcagcgcagtgctcttggccgggaggaggctgtgctgcaccagcacctcttgctccacatctccagagagcccagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgtgggcagtgcggagctggcactgttggtagccccaggcaagccccgacctggcaagccgctgcccccgaagacacgtggagagcagaggcagagcgccttcacggagctgccgaggatgaaggaccggcaggtggatgctcaggcccaggagagggagcacgatgaccccacaggccaacctggtgccccacagctgacccagaacatccccagaggcccagctggcagcaaagtcttctctgtgtggcccagcggagcacgaagtgagcaaagaagcgcctttagcaaaccaaccaagcgaccagcagagaggcctgagctaacctcagtcttccctgcaggggaatctgcagatgccctgggggagctgtctggactcctcaacactacagacctcgcttgttggggtcgactttcaactcccaagcttttggttggtgatttgtggaacttgcaagcattgccacagaatgctccactctgtagcacttttctgggtgcccctacactgtggctggagcatacccaggcccaggtgcccccaccctcatcatcctccaccacttcgtgggccctcctgccacccaccctcacctccctgggcttgtccacccagaactggtgtgcaaagtgcaacctgtcctttcgcctaacgtccgacctggtctttcacatgcgatcccaccacaaaaaggagcatgcggggcctgacccacattctcagaagcggagagaagaggcccttgcctgccctgtgtgccaggagcacttccgggagcgccaccacctctcccggcacatgacttctcacagctagcaggtgaccgcagaatgacctgctgggtgcagcagccagcctttggcagaggggggctccctgggcctgcgttgagggggctgtcatggtcctttgcagagctgctgcttttggcattcatagataaacagctcaggcataatttgaaaaagccacacctgcatgatgtgttttgaaggaaatgaagtcctgaaataaagtgatgggctttgcaaatccagggtagaggccctaacaggcacagagagcaggggcaactcctggcacacatcatgggctttggaggcacacaagcctggattcgaatctgggctctttcacatactagctgtgaccctggacaaagagctttaacctgctgagtccccattttctcatctgtgaaatggagatgataacactgtgtcttaggttggcattcaggtcacatgaaaggtgtgtggaaagtggccagcattctgcctgcagaccctgagcactgagtcaacaaggtttgtgatgatgtctgtactagttagctattgttattaacaagatctccatggcagacaagctaaagcatctgcctaagtcgtgagtctgtgggttggctcaggttaactgagcaggtggggatctcagccagcctcccagactgcacctcttctattgctctcctctgtccaccgttccaggcagcagcactcccacctggctgctctgatgtcctcgctccctccattcctgcctctcaccatgcacgcatccattgtccacacacacacaaccagataatcttctgaaagtgtaactcagatgatgcctccaaccctgtggctgcccttcacacttacaggcctaaccccagcaggacctgccagctgcttcatgaacaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaat

SEQ ID NO: 736840 - DNA, 719 bp, Homo sapiens
attcggcacgagggcaagtctcagatttgatcaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaat

SEQ ID NO: 736841 - DNA, 197 bp, Homo sapiens
tactactactaaattcgcggccgcgtcgaccagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaat

SEQ ID NO: 736842 - DNA, 3541 bp, Homo sapiens
tgctggtactgccccgggattaacgggcagcgcagtgctcttggccgggaggaggctgtgctgcaccagcacctcttgctccacatctccagagagcccagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgtgggcagtgcggagctggcactgttggtagccccaggcaagccccgacctggcaagccgctgcccccgaagacacgtggagagcagaggcagagcgccttcacggagctgccgaggatgaaggaccggcaggtggatgctcaggcccaggagagggagcacgatgaccccacaggccaacctggtgccccacagctgacccagaacatccccagaggcccagctggcagcaaagtcttctctgtgtggcccagcggagcacgaagtgagcaaagaagcgcctttagcaaaccaaccaagcgaccagcagagaggcctgagctaacctcagtcttccctgcaggggaatctgcagatgccctgggggagctgtctggactcctcaacactacagacctcgcttgttggggtcgactttcaactcccaagcttttggttggtgatttgtggaacttgcaagcattgccacagaatgctccactctgtagcacttttctgggtgcccctacactgtggctggagcatacccaggcccaggtgcccccaccctcatcatcctccaccacttcgtgggccctcctgccacccaccctcacctccctgggcttgtccacccagaactggtgtgcaaagtgcaacctgtcctttcgcctaacgtccgacctggtctttcacatgcgatcccaccacaaaaaggagcatgcggggcctgacccacattctcagaagcggagagaagaggcccttgcctgccctgtgtgccaggagcacttccgggagcgccaccacctctcccggcacatgacttctcacagctagcaggtgaccgcagaatgacctgctgggtgcagcagccagcctttggcagaggggggctccctgggcctgcgttgagggggctgtcatggtcctttgcagagctgctgcttttggcattcatagataaacagctcaggcataatttgaaaaagccacacctgcatgatgtgttttgaaggaaatgaagtcctgaaataaagtgatgggctttgcaaatccagggtagaggccctaacaggcacagagagcaggggcaactcctggcacacatcatgggctttggaggcacacaagcctggattcgaatctgggctctttcacatactagctgtgaccctggacaaagagctttaacctgctgagtccccattttctcatctgtgaaatggagatgataacactgtgtcttaggttggcattcaggtcacatgaaaggtgtgtggaaagtggccagcattctgcctgcagaccctgagcactgagtcaacaaggtttgtgatgatgtctgtactagttagctattgttattaacaagatctccatggcagacaagctaaagcatctgcctaagtcgtgagtctgtgggttggctcaggttaagctgagcttggctgggcttggcagcaagtctcagatttgatcaagtcatattcgttttcttcttcggctggtgggctacccagagcgagcacgcttctctcgtggtcatgccaagaacacaggagggtgagtctaacaagcacacctcaagcctctgcttgggtcacattgccaatgtcctctcagcccatacaagtggcaggaccaggcccaatattaaggagtggaaaagtgtaggctgcccttggtgaagctgtgacaagggagtgaccatccatcccctccacaggagggtgaggaattgggacaggtaattccagccaatacctggtccatagttcttcacattgtgagtatatgaatacggggaaatagaaccccctccccaccacctacacacatgctgttttaccttccaagaataggacatgtgcaaaaactaggcttccagatcgtgaggctggggagcattctaggtaccatttattatctactgcgtttcggtcagtagctgttgtaggtacccgcatcagcccttgttcctaaggatgtgtggagcccaggctgtactctttgacattccacaggtcagtctgcgtgaaagccctttgtggggagtttccaagccagtgtcgtttttgcactggtttccacctcactgtcagatattgttcttttgatatgcagtttccagccctccaatgagtccccagcacagatctcaggcttgtggctgggaataagcccagctgagcaggtggggatctcagccagcctcccagactgcacctcttctattgctctcctctgtccaccgttccaggcagcagcactcccacctggctgctctgatgtcctcgctccctccattcctgcctctcaccatgcacgcatccattgtccacacacacacaaccagataatcttctgaaagtgtaactcagatgatgcctccaaccctgtggctgcccttcacacttacaggcctaaccccagcaggacctgccagctgcttcatgaacaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaat

SEQ ID NO: 736843 - DNA, 3435 bp, Homo sapiens
tgctggtactgccccgggattaacgggcagcgcagtgctcttggccgggaggaggctgtgctgcaccagcacctcttgctccacatctccagagagcccagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagagcgccttcacggagctgccgaggatgaaggaccggcaggtggatgctcaggcccaggagagggagcacgatgaccccacaggccaacctggtgccccacagctgacccagaacatccccagaggcccagctggcagcaaagtcttctctgtgtggcccagcggagcacgaagtgagcaaagaagcgcctttagcaaaccaaccaagcgaccagcagagaggcctgagctaacctcagtcttccctgcaggggaatctgcagatgccctgggggagctgtctggactcctcaacactacagacctcgcttgttggggtcgactttcaactcccaagcttttggttggtgatttgtggaacttgcaagcattgccacagaatgctccactctgtagcacttttctgggtgcccctacactgtggctggagcatacccaggcccaggtgcccccaccctcatcatcctccaccacttcgtgggccctcctgccacccaccctcacctccctgggcttgtccacccagaactggtgtgcaaagtgcaacctgtcctttcgcctaacgtccgacctggtctttcacatgcgatcccaccacaaaaaggagcatgcggggcctgacccacattctcagaagcggagagaagaggcccttgcctgccctgtgtgccaggagcacttccgggagcgccaccacctctcccggcacatgacttctcacagctagcaggtgaccgcagaatgacctgctgggtgcagcagccagcctttggcagaggggggctccctgggcctgcgttgagggggctgtcatggtcctttgcagagctgctgcttttggcattcatagataaacagctcaggcataatttgaaaaagccacacctgcatgatgtgttttgaaggaaatgaagtcctgaaataaagtgatgggctttgcaaatccagggtagaggccctaacaggcacagagagcaggggcaactcctggcacacatcatgggctttggaggcacacaagcctggattcgaatctgggctctttcacatactagctgtgaccctggacaaagagctttaacctgctgagtccccattttctcatctgtgaaatggagatgataacactgtgtcttaggttggcattcaggtcacatgaaaggtgtgtggaaagtggccagcattctgcctgcagaccctgagcactgagtcaacaaggtttgtgatgatgtctgtactagttagctattgttattaacaagatctccatggcagacaagctaaagcatctgcctaagtcgtgagtctgtgggttggctcaggttaagctgagcttggctgggcttggcagcaagtctcagatttgatcaagtcatattcgttttcttcttcggctggtgggctacccagagcgagcacgcttctctcgtggtcatgccaagaacacaggagggtgagtctaacaagcacacctcaagcctctgcttgggtcacattgccaatgtcctctcagcccatacaagtggcaggaccaggcccaatattaaggagtggaaaagtgtaggctgcccttggtgaagctgtgacaagggagtgaccatccatcccctccacaggagggtgaggaattgggacaggtaattccagccaatacctggtccatagttcttcacattgtgagtatatgaatacggggaaatagaaccccctccccaccacctacacacatgctgttttaccttccaagaataggacatgtgcaaaaactaggcttccagatcgtgaggctggggagcattctaggtaccatttattatctactgcgtttcggtcagtagctgttgtaggtacccgcatcagcccttgttcctaaggatgtgtggagcccaggctgtactctttgacattccacaggtcagtctgcgtgaaagccctttgtggggagtttccaagccagtgtcgtttttgcactggtttccacctcactgtcagatattgttcttttgatatgcagtttccagccctccaatgagtccccagcacagatctcaggcttgtggctgggaataagcccagctgagcaggtggggatctcagccagcctcccagactgcacctcttctattgctctcctctgtccaccgttccaggcagcagcactcccacctggctgctctgatgtcctcgctccctccattcctgcctctcaccatgcacgcatccattgtccacacacacacaaccagataatcttctgaaagtgtaactcagatgatgcctccaaccctgtggctgcccttcacacttacaggcctaaccccagcaggacctgccagctgcttcatgaacaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaat

SEQ ID NO: 736844 - DNA, 783 bp, Homo sapiens; identical to SEQ ID NO: 123556

SEQ ID NO: 736845 - DNA, 387 bp, Homo sapiens
ttattcaaggacacacagtttaatacaggaagtgcctagtcattctgtgtctggccccagctgggaaaagttctccaattgagccagaaagatccttaaaaaggcagtgtactccaacttcctctgaagcttgtgtcctacctacagaattcccaaccactctgcttgaatgtctccaaagaggaaaaaatttagaagagaagacaaggaaaattaatcacaagataggcaatgaataggcaagtgaatgctgataatgccaagctgtgtttacagtccaaatttttgctgaagaccttcaactttgcactctccctgtgtggtatctcttgcccaagacagaacttcaaataaaatcacatagctgatgcaagaaaccgttaaaaa

SEQ ID NO: 736846 - DNA, 387 bp, Homo sapiens
ttctctagtcccttaatcatttgtaccattctctctctaatgcctataagggaactgtttaaatatagtccatatgggaaaagtaacctcaacatgttgtaacagggggcagaaaaacacgctgaatagatgaaaggaacaatctacaggttaattagtagtatggccacaaatatgtgcacagttttgtttcagaaataaagcaagctgtatttgttgtaactatctcttctttgaacttaacagaatgctgataatgccaagctgtgtttacagtccaaatttttgctgaagaccttcaactttgcactctccctgtgtggtatctcttgcccaagacagaacttcaaataaaatcacatagctgatgcaagaaaccgttaaaaa

SEQ ID NO: 736847 - DNA, 378 bp, Homo sapiens; identical to SEQ ID NO: 416992

SEQ ID NO: 736848 - DNA, 247 bp, Homo sapiens
  misc_feature (33)..(33): n is a, c, g, or t
gaagcgcgcagcggcgttctagaggatcccagnggggaacatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgatggttccccgcggggtaccgagctcgcaattcg

SEQ ID NO: 736849 - DNA, 7252 bp, Homo sapiens
cccaccctgcccccacccttcccccttcattcctctgtcccttgttctggaagctgaggcgagaatgtctcagttctgttcccttcaggcttcgagaccaccgccttgctgtgtcccgtagtggactgagggcctgcaagagggagtgagggctagtggagggccagctgcctgtgggggctggacatcgtgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagtttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 736850 - DNA, 7373 bp, Homo sapiens
cccaccctgcccccacccttcccccttcattcctctgtcccttgttctggaagctgaggcgagaatgtctcagttctgttcccttcaggcttcgagaccaccgccttgctgtgtcccgtagtggactgagggcctgcaagagggagtgagggctagtggagggccagctgcctgtgggggctggacatcgtggggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagtttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 736851 - DNA, 7348 bp, Homo sapiens
gtcacttttatttgggggtgtggacagctgctttcccaggggagtacttcttacagtgggatttcaagacaagatcggcctgaagaaaaattatatttgtatattttttaaaaagtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagtttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataacta

SEQ ID NO: 736852 - DNA, 7297 bp, Homo sapiens
gtcacttttatttgggggtgtggacagctgctttcccaggggagtacttcttacagtgggatttcaagacaagatcggcctgaagaaaaattatatttgtatattttttaaaaagtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagtttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 736853 - DNA, 2945 bp, Homo sapiens
tgtaactgaatgtttacacaaggatttaaatgtaataagcaagtagaatgttactgcattttatatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagtttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 736854 - DNA, 3679 bp, Homo sapiens
cgcggggaaccatcacttagttccagtgattgttccagtgattgttccagtgattgttccagtgattgttcagcggggaatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagtttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 736855 - DNA, 5982 bp, Homo sapiens
agagcggtgcgggtcgtgctggagaactaagcgcggcagacctcggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagtttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 736856 - DNA, 6910 bp, Homo sapiens
accgacgggtcgtcatgaggtcgcaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagtttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 736857 - DNA, 6079 bp, Homo sapiens
gttaatcctgatgcacagaactgggaataggccagatgccacattaatcaatttaagaatgctggagcttcgcagaatactgcatgaacaacgagaaccgtggccctgaaagactcaaaaccctacagtatatgaaactattgcaggatgtgtggatgttcaaaggaataacagacttggaagcaatgcttactgaattttgatgtattaaaggatgtcaagtccaagagagagataaggtctcagaagacagaactagaaccatggggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagtttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 736858 - DNA, 6578 bp, Homo sapiens
tactaaattcgcggccgcgtcgaccccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagtttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 736859 - DNA, 884 bp, Homo sapiens; identical to SEQ ID NO: 417008

SEQ ID NO: 736860 - DNA, 7362 bp, Homo sapiens
cacgaggggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagtttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 736861 - DNA, 1117 bp, Homo sapiens
  misc_feature (871)..(871): n is a, c, g, or t
  misc_feature (1117)..(1117): n is a, c, g, or t
cacgaggggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttnacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgggactgtgtatcaagaatcagaaataaatcatggcctcgttggcatcagcggtggagctgttcggccagn

SEQ ID NO: 736862 - DNA, 7426 bp, Homo sapiens
cacgaggggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaagacactagcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagtttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 736863 - DNA, 1652 bp, Homo sapiens
tacttttcctacttttccacagggtacttttcactttgggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 736864 - DNA, 6751 bp, Homo sapiens
  misc_feature (8)..(8): n is a, c, g, or t
agcgggtncaggagtttttcaaggctgaccacagtctaggcagaagaaattgcaattgtgaaaggaagatttgcgtgaaagaatggtgtttttggctgagtgaggaatttgaagtatctggaaaatggaagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagtttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaagtaaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 736865 - DNA, 3359 bp, Homo sapiens
  misc_feature (8)..(8): n is a, c, g, or t
agcgggtncaggagtttttcaaggctgaccacagtctaggcagaagaaattgcaattgtgaaaggaagatttgcgtgaaagaatggtgtttttggctgagtgaggaatttgaagtatctggaaaatggaagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgatgttccccgctatacatggacggcgcccagcgag

SEQ ID NO: 736866 - DNA, 1081 bp, Homo sapiens
  misc_feature (8)..(8): n is a, c, g, or t
agcgggtncaggagtttttcaaggctgaccacagtctaggcagaagaaattgcaattgtgaaaggaagatttgcgtgaaagaatggtgtttttggctgagtgaggaatttgaagtatctggaaaatggaagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttgaatgctgataatgccaagctgtgtttacagtccaaatttttgctgaagaccttcaactttgcactctccctgtgtggtatctcttgcccaagacagaacttcaaataaaatcacatagctgatgcaagaaaccgttaaaaa

SEQ ID NO: 736867 - DNA, 1053 bp, Homo sapiens
  misc_feature (8)..(8): n is a, c, g, or t
agcgggtncaggagtttttcaaggctgaccacagtctaggcagaagaaattgcaattgtgaaaggaagatttgcgtgaaagaatggtgtttttggctgagtgaggaatttgaagtatctggaaaatggaagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacggaccttggtttcaacattgtaggaggagaagatggagaaggaatattatttccttatcttagcaaggagctcacagagctgg

SEQ ID NO: 736868 - DNA, 986 bp, Homo sapiens
tgcggcccctctggatactcacacgttaattctatacgaaacagccttacttacaaaatagttacccataaatacaagtaataagaggatagattacaacctaaatatttttaaatggtaacgtacaaccccattgatctagatgagaggtcaggaaactttttccatgaagagccagttcgtaaacatatcggattttgtgggttatacaatctctgttacaactattcaactctgccatcatagcatgaaagcagccatacacaatctgcaaatgagtaagagtggctgttttccagtaaaactttatttacaaaaacaggctatcagctgtagtttgctgaccactgatctaatccttagtattttgaaagaaaaaaaatacccaacatcacactgttgttttaatttaaagaccaatctctgtcattcagcatttatgaaatactagttttactaaacattatatggattttctaaactcagttctccacctaaatttttcattggaactccaagcttcagaacaatgaatgagaacatctgttgcatttaagtaataaaatcttgcagattgccaatccaaatggcaggtgcggtggctcacacttatagtcccagcactttgggaggctgaggtaggtggatcacttgaggtcaggagtttgagatcagcctggccaacatggtgaaacgccatctctactaaaaaaaaaaatacaataattagccaggcatggtggcatacacctgtagtcccagctactcaggaggctaagggaggagaatcacttgaacctaggaggcaaaggctgcagtgagctgagatcatacccctgcaactccagcctgggagacagagagagacttgtctcaaaaaacaaacaaataaataaaattttaaaatgctatgtgacaaaacatttggcatgctgggtattcaggctcacaatcattttcgaaattattttccaaattgagtttct

SEQ ID NO: 736869 - DNA, 2271 bp, Homo sapiens
tctcggttcactgcagcctctgcctcctgggttcaagcaattctcatgcctcagcctccagagtagctgggattacaggcatgcgccaccatgcccagctaatttttttatttttagcagagatggggttttaccatgctgcccacgctggtcttgaactcttgacctcaggtgagccacccatctctgtctccccaaggttagggttacaggcgtgagccaccatgcccggccaaccctttcttaaagtaacaggaatttaacagcattaacctaaacactagaatgatgtacatttaatggattttcagaacatgatgacttccactgacccccattaacactagttatgtctatgtggttcatcataagaggagcaagtttagatgttcttcttttttttttttttgagacggagtctcgctctgtcgcccaggctggagtgcagtggcgcgatattggctcactgcaagctccgcctcccgggttcacgccattctcctgcctcagcttcccaaggggctgggactacaggcgcccgctaccacgcccagctaatttttttgtattttttgtagaggcggggtttcaccgtgttagccaggatggtcttgatctcctgacctcgtgatccacccgcctcggcctcccaaagtgctgggattacaggcgtgagccgccacgcccgccctagatgttcttcttaggcaatacaatttaacactaaaattaagatgttaccactaaatacagtgtctctcatgtttaaaatcattcaagtctttcttgcaggaagatttaagcttcatcagacactcatgggatgaggactgaggtatgaaatctacatgttttctgaccagaacacatccaacatggcctaaagattatcttactcttctaaattaagatcaaatagatttagagtaacttactgtagcagggttcttagatttgtattttatacagacgaatcaagaaaccattctactaatataaaatatcagtagttatgaaaattattttcaaccaaataaaaacaaattttaaaagaaaagttcaaaggaaatgtaacaaaatcattttcctatatctgttttggttcaaattagttcccaaaaactgtctccctcctagtcaaagatgttaaaaaacagcatataatgacttacatttaaactaaaattaaggtgggaaaatataattttaaataagtttaaacgagtcaaagacaaatgttctaaatttgaaaaaagttagacaataaagctaaattaacctaacatttctgaatgcttacctaaaccacgttaattctatacgaaacagccttacttacaaaatagttacccataaatacaagtaataagaggatagattacaacctaaatatttttaaatggtaacgtacaaccccattgatctagatgagaggtcaggaaactttttccatgaagagccagttcgtaaacatatcggattttgtgggttatacaatctctgttacaactattcaactctgccatcatagcatgaaagcagccatacacaatctgcaaatgagtaagagtggctgttttccagtaaaactttatttacaaaaacaggctatcagctgtagtttgctgaccactgatctaatccttagtattttgaaagaaaaaaaatacccaacatcacactgttgttttaatttaaagaccaatctctgtcattcagcatttatgaaatactagttttactaaacattatatggattttctaaactcagttctccacctaaatttttcattggaactccaagcttcagaacaatgaatgagaacatctgttgcatttaagtaataaaatcttgcagattgccaatccaaatggcaggtgcggtggctcacacttatagtcccagcactttgggaggctgaggtaggtggatcacttgaggtcaggagtttgagatcagcctggccaacatggtgaaacgccatctctactaaaaaaaaaaatacaataattagccaggcatggtggcatacacctgtagtcccagctactcaggaggctaagggaggagaatcacttgaacctaggaggcaaaggctgcagtgagctgagatcatacccctgcaactccagcctgggagacagagagagacttgtctcaaaaaacaaacaaataaataaaattttaaaatgctatgtgacaaaacatttggcatgctgggtattcaggctcacaatcattttcgaaattattttccaaattgagtttct

SEQ ID NO: 736870 - DNA, 2217 bp, Homo sapiens
tctcggttcactgcagcctctgcctcctgggttcaagcaattctcatgcctcagcctccagagtagctgggattacaggcatgcgccaccatgcccagctaatttttttatttttagcagagatggggttttaccatgctgcccacgctggtcttgaactcttgacctcaggtgagccacccatctctgtctccccaaggttagggttacaggcgtgagccaccatgcccggccaaccctttcttaaagtaacaggaatttaacagcattaacctaaacactagaatgatgtacatttaatggattttcagaacatgatgacttccactgacccccattaacactagttatgtctatgtggttcatcataagaggagcaagtttagatgttcttcttttttttttttttgagacggagtctcgctctgtcgcccaggctggagtgcagtggcgcgatattggctcactgcaagctccgcctcccgggttcacgccattctcctgcctcagcttcccaaggggctgggactacaggcgcccgctaccacgcccagctaatttttttgtattttttgtagaggcggggtttcaccgtgttagccaggatggtcttgatctcctgacctcgtgatccacccgcctcggcctcccaaagtgctgggattacaggcgtgagccgccacgcccgccctagatgttcttcttaggcaatacaatttaacactaaaattaagatgttaccactaaatacagtgtctctcatgtttaaaatcattcaagtctttcttgcaggaagatttaagcttcatcagacactcatgggatgaggactgaggtatgaaatctacatgttttctgaccagaacacatccaacatggcctaaagattatcttactcttctaaattaagatcaaatagatttagagtaacttactgtagcagggttcttagatttgtattttatacagacgaatcaagaaaccattctactaatataaaatatcagtagttatgaaaattattttcaaccaaataaaaacaaattttaaaagaaaagttcaaaggaaatgtaacaaaatcattttcctatatctgttttggttcaaattagttcccaaaaactgtctccctcctagtcaaagatgttaaaaaacagcatataatgacttacatttaaactaaaattaaggtgggaaaatataattttaaataagtttaaacgagtcaaagacaaatgttctaaatttgaaaaaagttagacaataaagctaaattaacctaacatttctgaatgcttacctaaaccacgttaattctatacgaaacagccttacttacaaaatagttacccataaatacaagtaataagaggatagattacaacctaaatatttttaaatggtaacgtacaaccccattgatctagatgagaggtcaggaaactttttccatgaagagccagttcgtaaacatatcggattttgtgggttatacaatctctgttacaactattcaactctgccatccagtaaaactttatttacaaaaacaggctatcagctgtagtttgctgaccactgatctaatccttagtattttgaaagaaaaaaaatacccaacatcacactgttgttttaatttaaagaccaatctctgtcattcagcatttatgaaatactagttttactaaacattatatggattttctaaactcagttctccacctaaatttttcattggaactccaagcttcagaacaatgaatgagaacatctgttgcatttaagtaataaaatcttgcagattgccaatccaaatggcaggtgcggtggctcacacttatagtcccagcactttgggaggctgaggtaggtggatcacttgaggtcaggagtttgagatcagcctggccaacatggtgaaacgccatctctactaaaaaaaaaaatacaataattagccaggcatggtggcatacacctgtagtcccagctactcaggaggctaagggaggagaatcacttgaacctaggaggcaaaggctgcagtgagctgagatcatacccctgcaactccagcctgggagacagagagagacttgtctcaaaaaacaaacaaataaataaaattttaaaatgctatgtgacaaaacatttggcatgctgggtattcaggctcacaatcattttcgaaattattttccaaattgagtttct

SEQ ID NO: 736871 - DNA, 1907 bp, Homo sapiens
atttttatttttgagacagagtcttcctctgtcgcccaagctggagtgcagtggcacgaatctcggctcactgcattccagcctgggcaacagagcgagactccatctcaaaaaaaaaaaaaaaattagccaggagtactggctcacacctataatcccagctactcgggaggatagtttgagcccaggagtttgaggctgtagtgagccttgattgggccattgcactccagtctggagtaccctgtctcaaaaataaataaataaatatttaaaaattctcaggtacataggaaaagcagggccagaagcggtggctcacatctgtaatcctagcactttggcaatacaatttaacactaaaattaagatgttaccactaaatacagtgtctctcatgtttaaaatcattcaagtctttcttgcaggaagatttaagcttcatcagacactcatgggatgaggactgaggtatgaaatctacatgttttctgaccagaacacatccaacatggcctaaagattatcttactcttctaaattaagatcaaatagatttagagtaacttactgtagcagggttcttagatttgtattttatacagacgaatcaagaaaccattctactaatataaaatatcagtagttatgaaaattattttcaaccaaataaaaacaaattttaaaagaaaagttcaaaggaaatgtaacaaaatcattttcctatatctgttttggttcaaattagttcccaaaaactgtctccctcctagtcaaagatgttaaaaaacagcatataatgacttacatttaaactaaaattaaggtgggaaaatataattttaaataagtttaaacgagtcaaagacaaatgttctaaatttgaaaaaagttagacaataaagctaaattaacctaacatttctgaatgcttacctaaaccacgttaattctatacgaaacagccttacttacaaaatagttacccataaatacaagtaataagaggatagattacaacctaaatatttttaaatggtaacgtacaaccccattgatctagatgagaggtcaggaaactttttccatgaagagccagttcgtaaacatatcggattttgtgggttatacaatctctgttacaactattcaactctgccatcatagcatgaaagcagccatacacaatctgcaaatgagtaagagtggctgttttccagtaaaactttatttacaaaaacaggctatcagctgtagtttgctgaccactgatctaatccttagtattttgaaagaaaaaaaatacccaacatcacactgttgttttaatttaaagaccaatctctgtcattcagcatttatgaaatactagttttactaaacattatatggattttctaaactcagttctccacctaaatttttcattggaactccaagcttcagaacaatgaatgagaacatctgttgcatttaagtaataaaatcttgcagattgccaatccaaatggcaggtgcggtggctcacacttatagtcccagcactttgggaggctgaggtaggtggatcacttgaggtcaggagtttgagatcagcctggccaacatggtgaaacgccatctctactaaaaaaaaaaatacaataattagccaggcatggtggcatacacctgtagtcccagctactcaggaggctaagggaggagaatcacttgaacctaggaggcaaaggctgcagtgagctgagatcatacccctgcaactccagcctgggagacagagagagacttgtctcaaaaaacaaacaaataaataaaattttaaaatgctatgtgacaaaacatttggcatgctgggtattcaggctcacaatcattttcgaaattattttccaaattgagtttct

SEQ ID NO: 736872 - DNA, 3354 bp, Homo sapiens
  misc_feature (2373)..(2373): n is a, c, g, or t
  misc_feature (2375)..(2375): n is a, c, g, or t
  misc_feature (3025)..(3025): n is a, c, g, or t
ggtttttccatggtgaagtttggaaaactgagggtctgagtccctcatttggtggtattagaatttaactgagtaggaggagagaagaaaacagtaacaaatgtcaaaatttcaagcaaccatgtggtatggctgtggtagagatgtatcaggcaattgaaagttttctaggtggtgccatcttgctaaaataataaaaagtacaggtttataaatcaaaaacaagtgcaatctatgtagggaaggattgtctatggatatacaagtggccagtgcaggaagtgaagtaacatttatctttatcttaatttctatgctcatgtcccccattccccttctgaagccaggcctgggaccttagatagcagcttagagggtctggccctgatacatttactcctttaattttggaatttccttctagtctctcaagagtgtttgtggcatatatttttcattttataaatataaaattgtacaaagtaatgtacattttgttttagagaagtcttttaaatgtttgcagacagcccagatcgtccatccctatttaggcagtggtctccaaacgtttatgtttattcaccctattagtaaaactttctgagcatgcccctccatgtatttatttatgatatatatgtatatatgtatacactgctatatatgtatatactgttttactgatgtaaacattaaaaaccatagcaaacatagacattttaaaagtatattttctggtcctcaatggagtttagagaatgggacaaggagtctttaggcgtagcacccagatgcctgtaattgattagagaatgtgtatataccatttgtggcaaagcagatataaaacaggcatggacgcatgattttaggtcaaggtatttaattatttttacttaaaataggcatttttggttgggaaagagaaggatgaacaatttgatgtcacctttaagactgatgtttttaattctgcttttgggaccacttgatctagaatgccttgaaaattccagaaagatttaacaacacactgaggtaagcaaaacaagaaaagaaagtaggggtgaggtgatacccagataatgcaaatgcaggatgtattgtctgtgaatttcagcatcaatctgaaaaacatgttttgataatgcctgataattcatcatctcactgattacatgtctttttttctatttgtttataatcttgtgtcttcaaatgtgtggaagatgtgcagacttatttttaggtatctgagataggaagggccaatgttggcataatttgaacccacatttcggggctaatgggcggacaccacctggaaacacttacctgcaccctctgttttgcaatcacaatgattagcatcttgctgaatgatgaccccaatgtgaagatggcatttcagtgtttatttctggatctatgagttactttagcagagttattagtagtttataaagccatatttaaacttgtacacttgattgtaagatagatttgaattgtgcactatgttgactactgtatataaatgtggaaattctgtatatttggtcttaatgctatatgtatttgatgtgtaaatgataactaatggatatgaaatagttttctgtgaatgtctttcttccaatttacttctcttttgcaaatttgaatgtttaaacttcaggctcatggggaaaatctgaaatgtttgcatctaatatactgttaagtggtggtctcttagatgactgggagagtattttagttgtaaggctcttgtataattaaaacagaggtaatgaattttttaggcatataactttgatagaatttcaagtgagtggcttttaagaagaaaaacagatctctggaatatgctgtcccatcctctcctgcttttatttcatgcccagtgtgcctcagagtgttacgaagtgtgagaaccactggtagagagaagacaaggaggagagggagagctgggagcacatgttgagacctttactatggctaggccttataatagaccaatttccccttgtataaatattgtctcaattaggcagggtgcagtggctcatgcctgtaatcccaggactttgggaggccaaggtgggcagatcacctgaggttgggagtttgagaccagcctgaccaacatggagaaaccctgtctctactaaaaatacaaaattagccgggcatggtggtgcatgcctgtaatcccagctacttgggaggctgaggcaggagaatcgcttgaacccaggaggtggaggctgcagtgagctgactttgtgccattgactccagcctgggcaacaagagcaaaactccatctcaaaaacacacacacacacacacacacacacacananatatagtctcaattagttttcatacctcttcaataaagtaattattgttcccaaattacagatgaagaaagacgtttgggatgataaactggcatatggtaatatggccatgatatgctcaagtctttagggtcagagattcacagcaagattttggaaattcaaatcttactatgaagtgattcacacatgtgtatggtaatgaaccttaaaggatagctgggcctataggcatgtcaagatctatagagacatgcaggatgtttcaaattctatcttaaaatttgaccaaatctttggtcaaataataatactgttactcaaatattagctttttaccatttagagcaaattacaatcaggtaacattcaaaattctaaccctcccttcccaacatgggaatatctattaagtaggaaatgagagaaccccctaatttcccatttcagtgataatactgattgagtatctcttatctgaagtgcttgggaccagaagtgttttggatctgggtttttctcagattttgaaatatttgcattataccagttgagtatcccaaaatcaaaactggaaatctgaaatgatccaatgtccgtttcctttgagtgtcatgttagtgctcaaaaagttttggattttggagcgnttcagattttggatttttggatttgggatgctcgacctgtagtttggttttcatctttttagactccatttctcttgacctataaatcctatcagccctgtttattaacatagaccctagtcagaaatactttgaaatagatctacatctacttcaacgtcagttggttccacacccttctagaacttgtgtggggtcctggacttcccgtctgtcctgttagggaagctttgctgtcctagctttcaggactcatcagagggaagagggtcatttacctttccaatgtgctgtgatctcagagtcgttaaaatacatgttttgctgcc

SEQ ID NO: 736873 - DNA, 2247 bp, Homo sapiens
tgtattgaagaatcctgccctcatttactgcaaggatgcctccaagccaatacacttgcattgtaaatgtttagtaatctcatgaacaagcaaaaagtatagtacttagcagttattggaaatattttgggggatttttaaaaaaacagataaatggtaaatatgtgcaatgaattttttggttaagaaagtaaaattttatctaatactaggtttttacttttttcactgtggtttgatatatatttttggttagaatgtactgattgtttttatgataagatgtatattttacttgcattcattcttaagaggtttctgtttttctattgagaatatctgttgaattaagtaggatttcagttagaaaaaggaattccgaaattaactggtctcaatctgattatatgtgctacatggccaaatcctattacagtgaattctaaggtgattcaaattgttttattgttatagaaatatgcagaaatcagatggcttcagagtcataaaatatttttcttgtaatagtatttaagcaatttgaccttatatgcaaacgttaagtgaatataaataagttctgtttcaattcatgtccatttaacaacattaaaataattattaggaacaccacatgaattttctttacatttgctgtggtataaattctgcttttaatgaatgtttatttatttattagccaaaattcagtttctctttgaacccagaattttgcaaagctgggggttggggagggggattattagctacttgttaactttttcagcatattatcattcctcttttaagactcaagtattattcactttgcttcttacaacccagagaatgtgaaaattctcctctattttatgtagcactattcacttaacattttttcaaagcactttataggatataaaaatagtacccggtaacatttaagtaaaggtagcagaaaacaaaagaactttcaaacagaaattatgttccctgccacctcctccacctcaaagaataataagcatgtggcataaatggagttgttcagaaaagctgtctgcataattttccttcaaggtaatgtatttgacagcatgaagtttgtgatgatcttacttggtctactactcagcggagtcttagaatctcttttatttacttctgagagattgttatttcaccagtatatgtgaacaggcttgctaaaggcattaaagatatggatcatggaggcaccaaatttggcttctgtatgcaatccagcattaacttcatccatacatttctaacttcatccataaatttctaacttcaagttaccttattttttatagttaagaatgtttttcgaggtttacaacagaatttaaaaaataattgttaggctttagaatcccactgtttgaaaagatccttttaatgtcaactttattgaaatatgtagtctactttctaatttcatctgataatatagcaggatttgatttttctgcctgccatttgtgcatttaaaaaaaaatcctcatttaagatttagagttctttaggttcaaattcctatgatgttttattgggtaacatgaactctcttatacataattcaaaatttcaatccatggtatattttatggtacattttgaaaagaaaatttgtaatgctccttagttacaaaaattagaaggaagctacataaaattcaggtgtcctaattaaattcaatttgattcaacacacgtattaggcataactcatacctaacactatttgataagggagacaggctccctgccatccaagaactcaacctagggagcagtgacaacagaaaccgggttgggttaaggcaaagagccatggataatgctgcaacatgagtggcacagaggggagtacacagagagagcaattaatttggtgtggggaaggtggtgatctgaatacagcagcagtttgaaagtgttccgtttttaaataaacagtatgcttattttgatttgtgactaggtgtagaaaaaagcctgcatagtgttacatatttatagtagttctttgtaaaaatgttaagtggatgagctattatgaaagtaaaagtttcattttttctcattaaaattagtactaaattactatggatcagatgataatattaaatagtactctgtagaaaaaaggtttcaagttgaattaatttatgtactgattattaatacagaataaatgttatattgactcaaaaaaaaaaa

SEQ ID NO: 736874 - DNA, 1515 bp, Homo sapiens
gtgtgttccaataagaaaaaaacatggctgtttgcttcggccccagggttgtagcttaccagtcctgtaacagatcacagtttgctcttttggtcacaaatacttgaacccctccctagttcagagcatttgataccgtaatatttaaagctcacttgtaaaacatcgtttgttgcctccatccatagtatctcaaacagaatgtctctcccaaatatacctaaattccatattctctgaagcacaaccagctattttcttgacatacttcctaacacaccccacagttcacaatttgatctgaaaacttgttaagggaggttctttggcatgtgatgccataaaaagagaggtatgggctctcctttaaaaaagagaccctttttatgagactcacaataggataaagagcccatgcctatttttaatcattttttcactatatagacatgcatgctgaaaaatgtttttattagtataatgctaattatactgacttcctatatattttagcatatagattcaaagattattagcacaataaggtagataacttcatagaccatttcttcatcttgttttcatttagtatgtaaaatttatctaaaatttacatgaaagatcagaatagctatgtaatgctactttgtaactcttatattttccaccagatgtcactaatgctgtaatattcaaattaagatgactttcttttggttctaaaggctgtaagcttattggaaaagcaaggttactcagcattggaattcctggcaacaaatatataaatacattaggggaataaacacttagcatttattatttactagtcacttcacatgaatttttatttaattctcatgcttttgtgcacaagtaaaactgggggtcaatgggcatgcaaattgtgtcgtggtttttgaagtttagtggtctctcctatccctggccaaggaagtatgcaaattgtattgtggtttttgaagtttaggtgatctcttccttctatccctagccaaggaagttcatcctgactccccaacaagcatatcaaaaggagtgtttcgtcacctttttcctcttaccctttacatccttttagcaataaagtgttcagaacaaactggttttcctttactgtgctttgcaaaacttattcatgttttattgggtgactttgtatttacactttcctcagatagtctgttgtcagatgactttgaccaatgattgggaggaaccaaatacagaggattttatcctatgcctaatctatattgtctacagagtaaatcaggtatgaatttgtgaacagtaatgaaacaattttccaactaatcagaagaattgtttgttaagtaaccttaattactcagtttttggtgaattgtttgcggcttaacttgtaaataatttcttattctttttttaaatgtatgaaatatttctagttattttgttcaatgtgactgataaaagtttatattggaatagctgtgaaatggaaaaagtcta

SEQ ID NO: 736875 - DNA, 658 bp, Homo sapiens
gtgggagccaaactatgagttttattgaggtgaagctatactggaaaagctttgccctgtagctccaagtggactgtcccatcctctttctagaccttgaggcttacctcaggaggatgatgtttaaatcaacagctgaaagacttgtgagtggtttctacaccatgttaaagagaaggttctaagacagcatgataggcctctaggcctggcctggactctggctcagtgttgcttaccatatgtagaggatgaacagaggttaagcccatcaaggtctgaagtagagcccaggaggaactgaactgtatctggctttcaggatccttttcccagtgtcatcaatcagagaagtcaaacctctgtgagaatgcttgtgcagaggtataacagtctcatgtattggttggcttttgctgcacctttctcattctgttggagggacattggttagtcaggactctgaaggccagctttttcacactgaccaaagcaagtgaaggtcaagcctaactttaatgggaccaggaagtatactcctcccatggaggtggtgggaatggcaccgagaagtttgatgacagttatctaattggactagaggttggcaaactttctgtaaatggccaggttagtaaaatagttctgcttttgaagg

SEQ ID NO: 736876 - DNA, 922 bp, Homo sapiens; identical to SEQ ID NO: 251670

SEQ ID NO: 736877 - DNA, 673 bp, Homo sapiens; identical to SEQ ID NO: 382542

SEQ ID NO: 736878 - DNA, 891 bp, Homo sapiens
  misc_feature (586)..(586): n is a, c, g, or t
aagcttggcacgaggtggcacgagggaaacactctgggtctctgcttgatcagtgtcccctctaaactgcacctcactacagtagggatggcataagatacttctttacacagcatctttttgttcccacctcacccccagagctgtaataggtagagccagccaaatgtcaaagggatgatttgtcttgtcaccactagtttcccttttctctgccttgtatgtaacaggaatattctttagttcctccttatgttctaaagcacctccccaacctaaaaatagaagaggagttgtgggtcatttacactttagtgtgaatttgcccttgtgactttgccaaggctgttgtgcctaaccctttcaatctaacagcagaatgagagtctctggactatcctggctccttccctgagaagaatgaactgggaattgttggtctagacatcaagactaccagagacctattgctcagagatgtttgggctgtacaatttctgtagatatggcatctggagcagccttttctaagcaatggcattatcattccaggctctctcgctctttccatctctccaccaggtgnactcttgccctccaccccttccaatttgtcagtgattcagagaacattctccatccttccaatgattacattccttcatcttgctggggcgccaattcagtgatggagcggctcttgggagcagccttggcttatagtgcagctctctgctaccttcaacaggctggtattcggggtgcttagatgtgactggttgtacgcacgtgtgtgtatgtgcatgtgtgtacagcagtaagagctttcgaggtagatacttgaggaagcctcagacatctagccccattactggggcaatgtcttacttg

SEQ ID NO: 736879 - DNA, 1157 bp, Homo sapiens
  misc_feature (981)..(981): n is a, c, g, or t
aatttcgggaatcgtcgaccacgcgtctactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtattttaaaacctttgnggaaaaaaaaaaaaaaaggcgggcccgttccagaaaaatccccctccagggggccccaggcttaaccggaacccccgtttttttttggaacaagggggcccccttataggggaccccatattaaagcttaggccccgggcccgccctttttacaacacccggggactgggaaacct

SEQ ID NO: 736880 - DNA, 1938 bp, Homo sapiens
ggcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgttactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccaggtaagcctcgaagtcgggacagggctgaacacccaggcaaggatgctgcgggaccctcggagctcccgattgcctcgcgtaactcttccctcttttcctctaatcagacagccgagctcgctccggaacttgtcatctccaacgacaaaaggagcttttgccactgactcggccgtgtcctgacacctccaggtgagtatctcctctcttggagagggaggtttaaacggcaagtcctggagttggcagacgttttgaaaaattgccactcactcggtttagggaaactgaggccagagagggacaagtgacttgcccatggttgcatcaaatgaatggcagagtcagtttccatgtgatgtgcatttaagccttaaatgcgcctgggccctgccctcccgcagtggccgagggtctggcaaagtagacatgggtccgactaaatacaagtctttctgttccatgttgtatagggagctgtcttcggcagccccctcccagctagtgtcaattccaagtaggaggggtagcgcaagctccgcctgtggtctttggcgccaactgggtgggggcagcgtggggcgcggagttatcagctggaggtacagaccaagtttcctccctggcgccggccagtctgcggacggcccccgcctcggcacgctcggcggaaactgactgctccttggtcttctttcctcccccgcccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatttaacacttgtgtatatgatgacacccgtct

SEQ ID NO: 736881 - DNA, 1424 bp, Homo sapiens
ggcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgttactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccaggtaagcctcgaagtcgggacagggctgaacacccaggcaaggatgctgcgggaccctcggagctcccgattgcctcgcgtaactcttccctcttttcctctaatcagacagccgagctcgctccggaacttgtcatctccaacgacaaaaggagcttttgccactgactcggccgtgtcctgacacctccaggtgagtatctcctctcttggagagggaggtttaaacggcaagtcctggagttggcagacgttttgaaaaattgccactcactcggtttagggaaactgaggccagagagggacaagtgacttgcccatggttgcatcaaatgaatggcagagtcagtttccatgtgatgtgcatttaagccttaaatgcgcctgggccctgccctcccgcagtggccgagggtctggcaaagtagacatgggtccgactaaatacaagtctttctgttccatgttgtatagggagctgtcttcggcagccccctcccagctagtgtcaattccaagtaggaggggtagcgcaagctccgcctgtggtctttggcgccaactgggtgggggcagcgtggggcgcggagttatcagctggaggtacagaccaagtttcctccctggcgccggccagtctgcggacggcccccgcctcggcacgctcggcggaaactgactgctccttgtcgtggcgattgggatcctaagagtcgccta

SEQ ID NO: 736882 - DNA, 1419 bp, Homo sapiens
ggcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgttactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccaggtaagcctcgaagtcgggacagggctgaacacccaggcaaggatgctgcgggaccctcggagctcccgattgcctcgcgtaactcttccctcttttcctctaatcagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatttaacacttgtgtatatgatgacacccgtct

SEQ ID NO: 736883 - DNA, 2585 bp, Homo sapiens
ggcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgttactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccaggtgagtatctcctctcttggagagggaggtttaaacggcaagtcctggagttggcagacgttttgaaaaattgccactcactcggtttagggaaactgaggccagagagggacaagtgacttgcccatggttgcatcaaatgaatggcagagtcagtttccatgtgatgtgcatttaagccttaaatgcgcctgggccctgccctcccgcagtggccgagggtctggcaaagtagacatgggtccgactaaatacaagtctttctgttccatgttgtatagggagctgtcttcggcagccccctcccagctagtgtcaattccaagtaggaggggtagcgcaagctccgcctgtggtctttggcgccaactgggtgggggcagcgtggggcgcggagttatcagctggaggtacagaccaagtttcctccctggcgccggccagtctgcggacggcccccgcctcggcacgctcggcggaaactgactgctccttggtcttctttcctcccccgcccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatttaaaaaaaaaaacacagaaaaaaacacgaaagaaagaaacagagaaacaaaaacacacgagcagagacgaagacagccagaacacacacgcgagtagaccacaagaccaaaaaagaaaagcaaacggatcaggagcggtaaaaacagaaagacaagcagcagcggagggatacagaagcgagcggggatcgcggaagcgaccagcagaagaccaggccgacggagtcgagacacaaggggcgcagtgagacgggagcgagggcagaaggcacgcggcacgtcgacagcactgcgtaggcgtaggagaaggtcaaactgaaagaaaacagtacgagcagcacggggcgacaaggaaagaaccgagaagagaagcgtagacaagcagggaaggccaaagcagacgagcaggagagggcacgatagactcggaagcgggacaaaaaacagagtaacacgagagcactacagagagagctactgcagaggtcgagctcgaacaaactgagagagacaggaaaacagcaaggaaaaagaaaggagacgaggaggagaggtaaggtaaggaaggagaggaaagaacaggaggagagaaagcggaaatgcaaaggagaggcgaaaagaggagagcggtaaaaaaagggagaaagaaaagaaacgaaaaaggaggaagcgcagacaagagaaaaagaggagaaagagaaaaaagaagcagaaggaacgaaaggaagagagcgcacagaagggagagccgcaaaagactcaggagacagaaaacagcagagac

SEQ ID NO: 736884 - DNA, 1312 bp, Homo sapiens
ggcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgttactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatttaacacttgtgtatatgatgacacccgtct

SEQ ID NO: 736885 - DNA, 2066 bp, Homo sapiens
ggcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgttactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatttaaaaaaaaaaacacagaaaaaaacacgaaagaaagaaacagagaaacaaaaacacacgagcagagacgaagacagccagaacacacacgcgagtagaccacaagaccaaaaaagaaaagcaaacggatcaggagcggtaaaaacagaaagacaagcagcagcggagggatacagaagcgagcggggatcgcggaagcgaccagcagaagaccaggccgacggagtcgagacacaaggggcgcagtgagacgggagcgagggcagaaggcacgcggcacgtcgacagcactgcgtaggcgtaggagaaggtcaaactgaaagaaaacagtacgagcagcacggggcgacaaggaaagaaccgagaagagaagcgtagacaagcagggaaggccaaagcagacgagcaggagagggcacgatagactcggaagcgggacaaaaaacagagtaacacgagagcactacagagagagctactgcagaggtcgagctcgaacaaactgagagagacaggaaaacagcaaggaaaaagaaaggagacgaggaggagaggtaaggtaaggaaggagaggaaagaacaggaggagagaaagcggaaatgcaaaggagaggcgaaaagaggagagcggtaaaaaaagggagaaagaaaagaaacgaaaaaggaggaagcgcagacaagagaaaaagaggagaaagagaaaaaagaagcagaaggaacgaaaggaagagagcgcacagaagggagagccgcaaaagactcaggagacagaaaacagcagagac

SEQ ID NO: 736886 - DNA, 1471 bp, Homo sapiens
  misc_feature (1295)..(1295): n is a, c, g, or t
ggcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgttactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtattttaaaacctttgnggaaaaaaaaaaaaaaaggcgggcccgttccagaaaaatccccctccagggggccccaggcttaaccggaacccccgtttttttttggaacaagggggcccccttataggggaccccatattaaagcttaggccccgggcccgccctttttacaacacccggggactgggaaacct

SEQ ID NO: 736887 - DNA, 1361 bp, Homo sapiens
ggcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgttactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatttttaaccccggcccaagatggaagctgcctcggccagaccatgtattacgaccaccccacgggggggggggcccccccc

SEQ ID NO: 736888 - DNA, 1329 bp, Homo sapiens
  misc_feature (1320)..(1320): n is a, c, g, or t
  misc_feature (1328)..(1329): n is a, c, g, or t
ggcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgttactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtattttataaaacaaaaaaaacttttctcgtacttctttttnatcaaaann

SEQ ID NO: 736889 - DNA, 1798 bp, Homo sapiens
ggcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgttactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatttaaaaaaaaaaacacagaaaaaaacacgaaagaaagaaacagagaaacaaaaacacacgagcagagacgaagacagccagaacacacacgcgagtagaccacaagaccaaaaaagaaaagcaaacggatcaggagcggtaaaaacagaaagacaagcagcagcggagggatacagaagcgagcggggatcgcggaagcgaccagcagaagaccaggccgacggagtcgagacacaaggggcgcagtgagacgggagcgagggcagaaggcacgcggcacgtcgacagcactgcgtaggcgtaggagaaggtcaaactgaaagaaaacagtacgagcagcacggggcgacaaggaaagaaccgagaagagaagcgtagacaagcagggaaggccaaagcagacgagcaggagagggcacgatagactcggaagcgggacaaaaaacagagtaacacgagagcactacagagagagctactgcagaggtcgagctcgaacaaactgagagagacaggaaaacagcaaggaaaaagaaaggagacgaggaggagaggtaaggtaaggaaggagaggaaagaacaggaggagagaaagcggaaatgcaaaggagaggcgaaaagaggagagcggtaaaaaaagggagaaagaaaagaaacgaaaaaggaggaagcgcagacaagagaaaaagaggagaaagagaaaaaagaagcagaaggaacgaaaggaagagagcgcacagaagggagagccgcaaaagactcaggagacagaaaacagcagagac

SEQ ID NO: 736890 - DNA, 2023 bp, Homo sapiens
ggcaacagaaaccggccgccccaccttcccatccaggtaagcctcgaagtcgggacagggctgaacacccaggcaaggatgctgcgggaccctcggagctcccgattgcctcgcgtaactcttccctcttttcctctaatcagacagccgagctcgctccggaacttgtcatctccaacgacaaaaggagcttttgccactgactcggccgtgtcctgacacctccaggtgagtatctcctctcttggagagggaggtttaaacggcaagtcctggagttggcagacgttttgaaaaattgccactcactcggtttagggaaactgaggccagagagggacaagtgacttgcccatggttgcatcaaatgaatggcagagtcagtttccatgtgatgtgcatttaagccttaaatgcgcctgggccctgccctcccgcagtggccgagggtctggcaaagtagacatgggtccgactaaatacaagtctttctgttccatgttgtatagggagctgtcttcggcagccccctcccagctagtgtcaattccaagtaggaggggtagcgcaagctccgcctgtggtctttggcgccaactgggtgggggcagcgtggggcgcggagttatcagctggaggtacagaccaagtttcctccctggcgccggccagtctgcggacggcccccgcctcggcacgctcggcggaaactgactgctccttggtcttctttcctcccccgcccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatttaaaaaaaaaaacacagaaaaaaacacgaaagaaagaaacagagaaacaaaaacacacgagcagagacgaagacagccagaacacacacgcgagtagaccacaagaccaaaaaagaaaagcaaacggatcaggagcggtaaaaacagaaagacaagcagcagcggagggatacagaagcgagcggggatcgcggaagcgaccagcagaagaccaggccgacggagtcgagacacaaggggcgcagtgagacgggagcgagggcagaaggcacgcggcacgtcgacagcactgcgtaggcgtaggagaaggtcaaactgaaagaaaacagtacgagcagcacggggcgacaaggaaagaaccgagaagagaagcgtagacaagcagggaaggccaaagcagacgagcaggagagggcacgatagactcggaagcgggacaaaaaacagagtaacacgagagcactacagagagagctactgcagaggtcgagctcgaacaaactgagagagacaggaaaacagcaaggaaaaagaaaggagacgaggaggagaggtaaggtaaggaaggagaggaaagaacaggaggagagaaagcggaaatgcaaaggagaggcgaaaagaggagagcggtaaaaaaagggagaaagaaaagaaacgaaaaaggaggaagcgcagacaagagaaaaagaggagaaagagaaaaaagaagcagaaggaacgaaaggaagagagcgcacagaagggagagccgcaaaagactcaggagacagaaaacagcagagac

SEQ ID NO: 736891 - DNA, 991 bp, Homo sapiens
gcctgggtggcgaaatgccatactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatttaacacttgtgtatatgatgacacccgtct

SEQ ID NO: 736892 - DNA, 805 bp, Homo sapiens
ttcggcacgagcggcacgagggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatttaacacttgtgtatatgatgacacccgtct

SEQ ID NO: 736893 - DNA, 1182 bp, Homo sapiens
ggacgcgtgggtcgcccacgcgtcgcccacgcgtcgctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatttaaaaaaaaaaacacagaaaaaaacacgaaagaaagaaacagagaaacaaaaacacacgagcagagacgaagacagccagaacacacacgcgagtagaccacaagaccaaaaaagaaaagcaaacggatcaggagcggtaaaaacagaaagacaagcagcagcggagggatacagaagcgagcggggatcgcggaagcgaccagcagaagaccaggccgacggagtcgagacacaaggggcgcagtgagacgggagcgagggcagaaggcacgcggcacgtcgacagcactgcgtaggcgtaggagaaggtcaaactgaaagaaaacagtacgagcagcacggggcgacaaggaaagaaccgagaagagaagcgtagacaagcagggaaggccaaagcagacgagcaggagagggcacgatagactcggaagcgggacaaaaaacagagtaacacgagagcactacagagagagctactgcagaggtcgagctcgaacaaactgagagagacaggaaaacagcaaggaaaaagaaaggagacgaggaggagaggtaaggtaaggaaggagaggaaagaacaggaggagagaaagcggaaatgcaaaggagaggcgaaaagaggagagcggtaaaaaaagggagaaagaaaagaaacgaaaaaggaggaagcgcagacaagagaaaaagaggagaaagagaaaaaagaagcagaaggaacgaaaggaagagagcgcacagaagggagagccgcaaaagactcaggagacagaaaacagcagagac

SEQ ID NO: 736894 - DNA, 250 bp, Homo sapiens
  misc_feature (11)..(11): n is a, c, g, or t
  misc_feature (230)..(230): n is a, c, g, or t
tgacaattcangtttttgaacatccagcttttcaccatcctttactctgctggcttcccagtagggagtttaatatttttttcgggattctcggctcccagtgtggctggtattatagaagagacagcatctttgaaatgagggcaaaccatctacacggacaggtctcgggtcctcagattgctccttccggctgctccatcttctagaagcatgacagttttttttgntttttgtttttttaaataag

SEQ ID NO: 736895 - DNA, 338 bp, Homo sapiens
  misc_feature (189)..(189): n is a, c, g, or t
  misc_feature (256)..(257): n is a, c, g, or t
  misc_feature (303)..(303): n is a, c, g, or t
  misc_feature (308)..(308): n is a, c, g, or t
  misc_feature (338)..(338): n is a, c, g, or t
cattattattgccatgatcactgaagccagctgaagctctatttgtggaattaagtctcagagggctgaaatgggctgtccaaggtcacacaagtgagtgagtcagggagggatcccagatttcctgattcctgaagcctttgccaaccatcagctcacacacagacgaatcattgcccaatgacctanaaatcggggtatctgatcacatccaagtaccacagctggtgatttaataagcactcaccatgtgttnnaaactgtgcaggctatatgaaagctttatagcatctataggtcagnataanaaggtcatctcattgcttatgccaaactan

SEQ ID NO: 736896 - DNA, 1135 bp, Homo sapiens
  misc_feature (401)..(401): n is a, c, g, or t
  misc_feature (650)..(650): n is a, c, g, or t
tccccagcactctgcccagcccaagctctcccagcctctgcctcccatcccccaggaggaaagacagtgcccaggctgggccaggcagctggccctggtgcccatgagcagaggggaccctccctggagaactcgaaaatgccagtgaacaaggcccaaacacctccatcctgagtccttctccagccttaaagcaaatcatcttttaatcctgaaacaccaaatatttaatttatgctctacctcaaatgtcaagcccacctcccatcacatagctttgaaaccacgtaaagaagcctaacactttccatatggcaaagacatggggccttttaattgtgccaactggtatcattcaagggtaattcccttggaatctggcactcgggcaacagctgggncagcctccaatctcatcacccaaccccacacgtccccatgggctccaagtaagcctgcaccctcctcatcttctccaaatatcaaagtgcactaggtacccccagtcaaattaccaaactgcctggcagccgcctttgatccagaggcgggcttgcctgcaccacggctctcagcctatttcttcaggcagctctgctgtaaaggaacaaaagggccaaccggggccatggggagattattttaaatcnggttgtacatattcacaatcagcctgtgagcatatacagaggcacacaggtcttcaccaagtgtttcccacctgatacctgagtccactgcactatttaatctatctattaagctttttcacttgtccattctattttccacacccagtgtttccaattggttttcttctctaactgcctgttgctgcttcatgtttccagcatcctccgtttctctctgagtttatgatgcttattttgctttctaattgtttaacatggtgttctttgccgcgtgtgctgatcagtttattgctcctcttccacagtactcgtgcgcctcccatttctcattccttttctcctatgagtccatattcccttggacttgctcatgtccccatggaaagggcaaaagcccagcccttggcctgcgtccctccaagtgagcctgccatgacagtgggggaggcagagagcctctagcattcttatcccagccctat

SEQ ID NO: 736897 - DNA, 416 bp, Homo sapiens
cgcctgcgagcgaactctagagagcgcaacccctatctattaagctttttcacttgtccattctattttccacacccagtgtttccaattggttttcttctctaactgcctgttgctgcttcatgtttccagcatcctccgtttctctctgagtttatgatgcttattttgctttctaattgtttaacatggtgttctttgccgcgtgtgctgatcagtttattgctcctcttccacagtactcgtgcgcctcccatttctcattccttttctcctatgagtccatattcccttggacttgctcatgtccccatggaaagggcaaaagcccagcccttggcctgcgtccctccaagtgagcctgccatgacagtgggggaggcagagagcctctagcattcttatcccagccctat

SEQ ID NO: 736898 - DNA, 907 bp, Homo sapiens; identical to SEQ ID NO: 116138

SEQ ID NO: 736899 - DNA, 1008 bp, Homo sapiens
gggccagagcttgcggggcgcacagagcccccaggcctcatggcgcagaaacctctcagcaccgcggcggctgaacgcatgaaccttgtgggtcaggatgagatctggaaataccgtctgaaggctgaatcggaagcacggcagaactggccccagaactgggggtttttaacaaccccttttgaggagttgatcaagtgtgaagaagatctccccaccccaaagcccaaaatcgagcttcctgagcgtttccgcatccggccggtgaccccagtggagaagtacatcaaggtctttccatcccccccagtcccacagaccacccagggcttcatcggctggagatctgcagtgccaggcctgaacaagtgcctagagctcgacgatgcgatcagaagctgcaaaggtgcttttgcacgagagctgtgctggcccaagcagggcgtgcactgaatccagacggagttctgcccaggggtgctgcatatcggtcaccaggcacccagggccatgccagggaaaggaagagctcccctgaatcccgaggacacagtcccctgcgtacttgctcatgggatgttgcaaagaacacaaagtgtgccttagacattctcaagtcatcagcgtcacccttccagaatcccgaggacacagtcccctgcgtacttgctcatgggatgttgcaaagaacacaaagtgtgccttagacattttcaagtcatcagcgtcacccttccagaatgttcacgtccacacccattcttggctaatgtaatgaataaggcttctctcatttgtttttgataccttgggaatttctatgcagggctttaaaaaaaaataagtgattcaattttaaaaatatttgtctaggtccttcaatgtagcttttcattgcacctatcatcatccttatttataacgaacttgttgatcaggtgtttctctatccagatatccctgggcctgtttttcaggaagaagaatacacttagagaatcccttggc

SEQ ID NO: 736900 - DNA, 887 bp, Homo sapiens
ttttttttttttgagacggagtcccgctctgtcgcccaggctggagtgcagcgggtttaggctttttaagggaccccctcccaatcagggcaacagagggatgcccaaggtgaccgccaacaccttcctggggggctgactccagggctcaggaggaagggaccagccttcttcgccaagagggggagccctagcatgcacttctgggctggctttacccaaatagtgaggcaccccaggtgtggagacctccctctccccactccaaacaccactgggtcagggggctgccagccagccacctccagcagcccaggcaggaagccggaaatgatgcagcccaaattcctcttggtggggtttcctgtaagtggggagccgcccagggcaggatcataaatgggctgatctgaggtctgtggtcctaccggagaagccaggcatggaaggctgactatatatccacggccaatggctccagagccctaagccatgggcagaccagatgtggtgagtgaccctggctatggcagtaaccaagaccaggatgcaggagtgtggtccaagggtttgcctggcactttcccccagcctgggggaggggttctccttctcctccaggtgacctgagaagaatggtaggcaaaggacactgtcctggtctgggcagccgctattggtgtcagctcatttctggatgacacagatgggacgcccaccctaaccattctgtctcctccctctgtgcaagtgcccttgggactacccagattgtagtttaaggtgaagggatccttgcgtcaagaagctccttggaccaaacctgggacggaaaggacaggaactgtaagggaactcgtcagccctccccctgcgcttctggctcc

SEQ ID NO: 736901 - DNA, 2362 bp, Homo sapiens
ctccccctccccgcgctccgcagctgggaatcacgggactagccttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatggatatggcttggcatacgacttatctaagatcccaaccagtataaaaggatatactttgggagccagaacagctgtgaggtttaagccaatacagaaggaaatgacacctcatgcaggcaggtaccagaaagtaagtcctcagcaggaaaaacacaaacaaaattttgctccatttaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctggggtctgtgggtttctgttgggtgctgagttgggtgatttcattttagtgaaatatttgtgggcccctgctctctagttctaattcccaggagccaattttatatattctaccactagccctggtcataggaggctgttagcctatacatgtcaagggtttggatgggatttgggcttgctagatacagaaaacacttaaggcagattaaaacatgtattggagctctcccaattgtgttgctcagtgtggagtgggaaggtcttgatttggttgactttcccagattgacataaaactcaaaaaccaaaaaattgcccctttcctatgacatcatccatttagtctgtgagtcaacatatatactgaggtcctactatgtgttgagcagagcagtaagcactggggatatggcaggaatcaaaataaacttatctactaagtccttgggcctggcctgaagtcagaggaggactccccagggcagctaggggattgggtctgccctccaatctgaatgaccccctagaaccttacaagtcattctggggttataaagatcataacatttatagccccagactgacttgtaagcagctgcatttaaagtacttactcagacactcaggcctgagagatagacccctttctttccagcactagctgaaataatcaagtatatagtttgttcaggattggcactaaatgtgatttaatcttttaataaaagggtccttttgtacccacttaggcttcttcgtaattaccagaaaggtgataagcctgcatgtgtctggacaccaaagattgagaagctgccagtggctgcaagagagcctactgtaaccctcatggccaccccctgatgagtgttacctggggaaagggctagcaagaggtgaagcctcctggtcatatgatgctgggggtgcctaattccttaaaggccaaggtcttctgaaataataatggtgaaggacagaaaagtctttatgagaaatcacataggatatattaagataatgataaagatacctcagcaagaacatacctaatatatacacttcttttaatctgatgacttaatgatttctgttatcaagaagtatttatgacttgagataagtcaggattaactgttatcacctctcctgtacacctccctcctttttctcctttgtacccacatgtgcagattttttcagaggtgacaatttagcatttaatgtttttttttctgcttcaagttcttaggtccctttggaggatattgatgggggtggaggtggggatagaacatctttcacactgtttggtacagagatgctcaaagcttttcccagggaaaggaactctctaaaatagtaatctgatttgatgaaagataaaattttaatatagcttcagttaaccttcaggatactttaaatgctacattgtatataaaagtaataaagtacaaatgaacacgaagacta

SEQ ID NO: 736902 - DNA, 880 bp, Homo sapiens
ctccccctccccgcgctccgcagctgggaatcacgggactagccttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatggatatggcttggcatacgacttatctaagatcccaaccagtataaaaggatatactttgggagccagaacagctgtgaggtttaagccaatacagaaggaaatgacacctcatgcaggcaggtaccagaaagtaagtcctcagcaggaaaaacacaaacaaaattttgctccatttaatgtcttggtgcctcgatttaagaactacccaaaggacacttactatcccaggtatgtctcctcccttttggtgcacttcaacaaaaaaagcaataggaggaaaagaagtacgtaataaaagaagcacataaagaagggatgacatccaaaccatcgcagttaaataaggaaccattcagagatttaatcaattgtctcacagatttctggcattgtagaatgtagaatcatagttactcattcaatgaatttttattaacatgccaggtagttttgtaggttcgatagatttttgcactaaatccatcacacaaggctcctgatttcttggggcttacattctagagtccagacagagcacaggcaaatacacaagaaaatatcaatagtgatagagtgaccatataatttgttagtcaaacgatgacacttctgagagtaaaagggg

SEQ ID NO: 736903 - DNA, 2263 bp, Homo sapiens
ctccccctccccgcgctccgcagctgggaatcacgggactagccttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatgaaatgacacctcatgcaggcaggtaccagaaagtaagtcctcagcaggaaaaacacaaacaaaattttgctccatttaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctggggtctgtgggtttctgttgggtgctgagttgggtgatttcattttagtgaaatatttgtgggcccctgctctctagttctaattcccaggagccaattttatatattctaccactagccctggtcataggaggctgttagcctatacatgtcaagggtttggatgggatttgggcttgctagatacagaaaacacttaaggcagattaaaacatgtattggagctctcccaattgtgttgctcagtgtggagtgggaaggtcttgatttggttgactttcccagattgacataaaactcaaaaaccaaaaaattgcccctttcctatgacatcatccatttagtctgtgagtcaacatatatactgaggtcctactatgtgttgagcagagcagtaagcactggggatatggcaggaatcaaaataaacttatctactaagtccttgggcctggcctgaagtcagaggaggactccccagggcagctaggggattgggtctgccctccaatctgaatgaccccctagaaccttacaagtcattctggggttataaagatcataacatttatagccccagactgacttgtaagcagctgcatttaaagtacttactcagacactcaggcctgagagatagacccctttctttccagcactagctgaaataatcaagtatatagtttgttcaggattggcactaaatgtgatttaatcttttaataaaagggtccttttgtacccacttaggcttcttcgtaattaccagaaaggtgataagcctgcatgtgtctggacaccaaagattgagaagctgccagtggctgcaagagagcctactgtaaccctcatggccaccccctgatgagtgttacctggggaaagggctagcaagaggtgaagcctcctggtcatatgatgctgggggtgcctaattccttaaaggccaaggtcttctgaaataataatggtgaaggacagaaaagtctttatgagaaatcacataggatatattaagataatgataaagatacctcagcaagaacatacctaatatatacacttcttttaatctgatgacttaatgatttctgttatcaagaagtatttatgacttgagataagtcaggattaactgttatcacctctcctgtacacctccctcctttttctcctttgtacccacatgtgcagattttttcagaggtgacaatttagcatttaatgtttttttttctgcttcaagttcttaggtccctttggaggatattgatgggggtggaggtggggatagaacatctttcacactgtttggtacagagatgctcaaagcttttcccagggaaaggaactctctaaaatagtaatctgatttgatgaaagataaaattttaatatagcttcagttaaccttcaggatactttaaatgctacattgtatataaaagtaataaagtacaaatgaacacgaagacta

SEQ ID NO: 736904 - DNA, 2222 bp, Homo sapiens
ctccccctccccgcgctccgcagctgggaatcacgggactagccttcgtttccttggcaacgcagtacacaagtgctagccctagcagctcgcgatgtgcttcagcagagcagggatatggcttggcatacgacttatctaagatcccaaccagtataaaaggatatactttgggagccagaacagctgtgaggtttaagccaatacagaaggaaatgacacctcatgcaggcaggtaccagaaagtaagtcctcagcaggaaaaacacaaacaaaattttgctccatttaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctggggtctgtgggtttctgttgggtgctgagttgggtgatttcattttagtgaaatatttgtgggcccctgctctctagttctaattcccaggagccaattttatatattctaccactagccctggtcataggaggctgttagcctatacatgtcaagggtttggatgggatttgggcttgctagatacagaaaacacttaaggcagattaaaacatgtattggagctctcccaattgtgttgctcagtgtggagtgggaaggtcttgatttggttgactttcccagattgacataaaactcaaaaaccaaaaaattgcccctttcctatgacatcatccatttagtctgtgagtcaacatatatactgaggtcctactatgtgttgagcagagcagtaagcactggggatatggcaggaatcaaaataaacttatctactaagtccttgggcctggcctgaagtcagaggaggactccccagggcagctaggggattgggtctgccctccaatctgaatgaccccctagaaccttacaagtcattctggggttataaagatcataacatttatagccccagactgacttgtaagcagctgcatttaaagtacttactcagacactcaggcctgagagatagacccctttctttccagcactagctgaaataatcaagtatatagtttgttcaggattggcactaaatgtgatttaatcttttaataaaagggtccttttgtacccacttaggcttcttcgtaattaccagaaaggtgataagcctgcatgtgtctggacaccaaagattgagaagctgccagtggctgcaagagagcctactgtaaccctcatggccaccccctgatgagtgttacctggggaaagggctagcaagaggtgaagcctcctggtcatatgatgctgggggtgcctaattccttaaaggccaaggtcttctgaaataataatggtgaaggacagaaaagtctttatgagaaatcacataggatatattaagataatgataaagatacctcagcaagaacatacctaatatatacacttcttttaatctgatgacttaatgatttctgttatcaagaagtatttatgacttgagataagtcaggattaactgttatcacctctcctgtacacctccctcctttttctcctttgtacccacatgtgcagattttttcagaggtgacaatttagcatttaatgtttttttttctgcttcaagttcttaggtccctttggaggatattgatgggggtggaggtggggatagaacatctttcacactgtttggtacagagatgctcaaagcttttcccagggaaaggaactctctaaaatagtaatctgatttgatgaaagataaaattttaatatagcttcagttaaccttcaggatactttaaatgctacattgtatataaaagtaataaagtacaaatgaacacgaagacta

SEQ ID NO: 736905 - DNA, 2353 bp, Homo sapiens
ggtgcgttgaagagagtctgacgcgggagttaggtaagtacccttgggggaacactgttaagcagaggaaaattatcccattatttctatcccccgtgaagttggatggggacccgcagttgggtccctcctatagggagttcaccactgacagtagggccttggcgttggtattcattacacgatggatagtggcttggaaagtgactgagcgttaatcgtaaaggtactcccaatacactacgtcattcacacaacggcactatactttggtggagcctggcacagaggagggaggcttcaagccaaactcacagaaggaaactgacatcctatcatgcaagtgcgacggctacgctagaaagttagatccatccatgacaggaataaataacatgacatgagtttggctccggttattaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctggggtctgtgggtttctgttgggtgctgagttgggtgatttcattttagtgaaatatttgtgggcccctgctctctagttctaattcccaggagccaattttatatattctaccactagccctggtcataggaggctgttagcctatacatgtcaagggtttggatgggatttgggcttgctagatacagaaaacacttaaggcagattaaaacatgtattggagctctcccaattgtgttgctcagtgtggagtgggaaggtcttgatttggttgactttcccagattgacataaaactcaaaaaccaaaaaattgcccctttcctatgacatcatccatttagtctgtgagtcaacatatatactgaggtcctactatgtgttgagcagagcagtaagcactggggatatggcaggaatcaaaataaacttatctactaagtccttgggcctggcctgaagtcagaggaggactccccagggcagctaggggattgggtctgccctccaatctgaatgaccccctagaaccttacaagtcattctggggttataaagatcataacatttatagccccagactgacttgtaagcagctgcatttaaagtacttactcagacactcaggcctgagagatagacccctttctttccagcactagctgaaataatcaagtatatagtttgttcaggattggcactaaatgtgatttaatcttttaataaaagggtccttttgtacccacttaggcttcttcgtaattaccagaaaggtgataagcctgcatgtgtctggacaccaaagattgagaagctgccagtggctgcaagagagcctactgtaaccctcatggccaccccctgatgagtgttacctggggaaagggctagcaagaggtgaagcctcctggtcatatgatgctgggggtgcctaattccttaaaggccaaggtcttctgaaataataatggtgaaggacagaaaagtctttatgagaaatcacataggatatattaagataatgataaagatacctcagcaagaacatacctaatatatacacttcttttaatctgatgacttaatgatttctgttatcaagaagtatttatgacttgagataagtcaggattaactgttatcacctctcctgtacacctccctcctttttctcctttgtacccacatgtgcagattttttcagaggtgacaatttagcatttaatgtttttttttctgcttcaagttcttaggtccctttggaggatattgatgggggtggaggtggggatagaacatctttcacactgtttggtacagagatgctcaaagcttttcccagggaaaggaactctctaaaatagtaatctgatttgatgaaagataaaattttaatatagcttcagttaaccttcaggatactttaaatgctacattgtatataaaagtaataaagtacaaatgaacacgaagacta

SEQ ID NO: 736906 - DNA, 1772 bp, Homo sapiens
acgcggaccgtcagctttagggtctttgctttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctggggtctgtgggtttctgttgggtgctgagttgggtgatttcattttagtgaaatatttgtgggcccctgctctctagttctaattcccaggagccaattttatatattctaccactagccctggtcataggaggctgttagcctatacatgtcaagggtttggatgggatttgggcttgctagatacagaaaacacttaaggcagattaaaacatgtattggagctctcccaattgtgttgctcagtgtggagtgggaaggtcttgatttggttgactttcccagattgacataaaactcaaaaaccaaaaaattgcccctttcctatgacatcatccatttagtctgtgagtcaacatatatactgaggtcctactatgtgttgagcagagcagtaagcactggggatatggcaggaatcaaaataaacttatctactaagtccttgggcctggcctgaagtcagaggaggactccccagggcagctaggggattgggtctgccctccaatctgaatgaccccctagaaccttacaagtcattctggggttataaagatcataacatttatagccccagactgacttgtaagcagctgcatttaaagtacttactcagacactcaggcctgagagatagacccctttctttccagcactagctgaaataatcaagtatatagtttgttcaggattggcactaaatgtgatttaatcttttaataaaagggtccttttgtacccacttaggcttcttcgtaattaccagaaaggtgataagcctgcatgtgtctggacaccaaagattgagaagctgccagtggctgcaagagagcctactgtaaccctcatggccaccccctgatgagtgttacctggggaaagggctagcaagaggtgaagcctcctggtcatatgatgctgggggtgcctaattccttaaaggccaaggtcttctgaaataataatggtgaaggacagaaaagtctttatgagaaatcacataggatatattaagataatgataaagatacctcagcaagaacatacctaatatatacacttcttttaatctgatgacttaatgatttctgttatcaagaagtatttatgacttgagataagtcaggattaactgttatcacctctcctgtacacctccctcctttttctcctttgtacccacatgtgcagattttttcagaggtgacaatttagcatttaatgtttttttttctgcttcaagttcttaggtccctttggaggatattgatgggggtggaggtggggatagaacatctttcacactgtttggtacagagatgctcaaagcttttcccagggaaaggaactctctaaaatagtaatctgatttgatgaaagataaaattttaatatagcttcagttaaccttcaggatactttaaatgctacattgtatataaaagtaataaagtacaaatgaacacgaagacta

SEQ ID NO: 736907 - DNA, 2330 bp, Homo sapiens
ctccccctccccgcgctccgcagctgggaatcacgggactagccttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatggatatggcttggcatacgacttatctaagatcccaaccagtataaaaggatatactttgggagccagaacagctgtgaggtttaagccaatacagaaggaaatgacacctcatgcaggcaggtaccagaaagtaagtcctcagcaggaaaaacacaaacaaaattttgctccatttaatgtcttggtgcctcgatttaagaactacccaaaggacacttactatcccagcgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctggggtctgtgggtttctgttgggtgctgagttgggtgatttcattttagtgaaatatttgtgggcccctgctctctagttctaattcccaggagccaattttatatattctaccactagccctggtcataggaggctgttagcctatacatgtcaagggtttggatgggatttgggcttgctagatacagaaaacacttaaggcagattaaaacatgtattggagctctcccaattgtgttgctcagtgtggagtgggaaggtcttgatttggttgactttcccagattgacataaaactcaaaaaccaaaaaattgcccctttcctatgacatcatccatttagtctgtgagtcaacatatatactgaggtcctactatgtgttgagcagagcagtaagcactggggatatggcaggaatcaaaataaacttatctactaagtccttgggcctggcctgaagtcagaggaggactccccagggcagctaggggattgggtctgccctccaatctgaatgaccccctagaaccttacaagtcattctggggttataaagatcataacatttatagccccagactgacttgtaagcagctgcatttaaagtacttactcagacactcaggcctgagagatagacccctttctttccagcactagctgaaataatcaagtatatagtttgttcaggattggcactaaatgtgatttaatcttttaataaaagggtccttttgtacccacttaggcttcttcgtaattaccagaaaggtgataagcctgcatgtgtctggacaccaaagattgagaagctgccagtggctgcaagagagcctactgtaaccctcatggccaccccctgatgagtgttacctggggaaagggctagcaagaggtgaagcctcctggtcatatgatgctgggggtgcctaattccttaaaggccaaggtcttctgaaataataatggtgaaggacagaaaagtctttatgagaaatcacataggatatattaagataatgataaagatacctcagcaagaacatacctaatatatacacttcttttaatctgatgacttaatgatttctgttatcaagaagtatttatgacttgagataagtcaggattaactgttatcacctctcctgtacacctccctcctttttctcctttgtacccacatgtgcagattttttcagaggtgacaatttagcatttaatgtttttttttctgcttcaagttcttaggtccctttggaggatattgatgggggtggaggtggggatagaacatctttcacactgtttggtacagagatgctcaaagcttttcccagggaaaggaactctctaaaatagtaatctgatttgatgaaagataaaattttaatatagcttcagttaaccttcaggatactttaaatgctacattgtatataaaagtaataaagtacaaatgaacacgaagacta

SEQ ID NO: 736908 - DNA, 905 bp, Homo sapiens
  misc_feature (626)..(626): n is a, c, g, or t
  misc_feature (639)..(639): n is a, c, g, or t
  misc_feature (641)..(641): n is a, c, g, or t
actagttctagatcgcgagcggctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaaaaaaaaaacaaaccacacnaacaaaaaaacananaaaaacagacggcacggaccaaaacaaagcaacaacaaccaacacaaaaagacacgaacccggaagagcacaaaacaacaagaaaaacaaaaaagaccagaaagaaagcataatatatatgcggggcaagagaccagccagaacagacagagaaaggaaaaaaaaagaaaagaaacgaaaaaaagggagaaaacaaaggagagaggaagacaggggagacacaagaaaaacaccaggagcatagcaaccccaaaccacgaagat

SEQ ID NO: 736909 - DNA, 418 bp, Homo sapiens
gcagctcgtaccccgatatttgtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagggccagaaccacaaatatcgggggcgagcagc

SEQ ID NO: 736910 - DNA, 746 bp, Homo sapiens
cccatgggaccttggcagcttcattcgggcagcatgacagcactacatttgtggaacctcgcacgtgacagccgtgcgctggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggatttcacagaagtgggagtcgagctcgacttggtaa

SEQ ID NO: 736911 - DNA, 473 bp, Homo sapiens
ccggagtctcgcgcccgcggtcatgtgacacagcgaagatggcgtcgcccggcgtgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgaggacagagactaagagatggccttcacctgccatgagcaatgggacctagaaggaggcacaactcccggc

SEQ ID NO: 736912 - DNA, 2359 bp, Homo sapiens
ccggagtctcgcgcccgcggtcatgtgacacagcgaagatggcgtcgcccggcgtgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagggccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaaaaaaaaagttgacgccgccggattttatgaagaagtattcgca

SEQ ID NO: 736913 - DNA, 2614 bp, Homo sapiens
  misc_feature (2335)..(2335): n is a, c, g, or t
  misc_feature (2348)..(2348): n is a, c, g, or t
  misc_feature (2350)..(2350): n is a, c, g, or t
ccggagtctcgcgcccgcggtcatgtgacacagcgaagatggcgtcgcccggcgtgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagggccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaaaaaaaaaacaaaccacacnaacaaaaaaacananaaaaacagacggcacggaccaaaacaaagcaacaacaaccaacacaaaaagacacgaacccggaagagcacaaaacaacaagaaaaacaaaaaagaccagaaagaaagcataatatatatgcggggcaagagaccagccagaacagacagagaaaggaaaaaaaaagaaaagaaacgaaaaaaagggagaaaacaaaggagagaggaagacaggggagacacaagaaaaacaccaggagcatagcaaccccaaaccacgaagat

SEQ ID NO: 736914 - DNA, 2560 bp, Homo sapiens
  misc_feature (2281)..(2281): n is a, c, g, or t
  misc_feature (2294)..(2294): n is a, c, g, or t
  misc_feature (2296)..(2296): n is a, c, g, or t
ccggagtctcgcgcccgcggtcatgtgacacagcgaagatggcgtcgcccggcgtgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagggccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaaaaaaaaaacaaaccacacnaacaaaaaaacananaaaaacagacggcacggaccaaaacaaagcaacaacaaccaacacaaaaagacacgaacccggaagagcacaaaacaacaagaaaaacaaaaaagaccagaaagaaagcataatatatatgcggggcaagagaccagccagaacagacagagaaaggaaaaaaaaagaaaagaaacgaaaaaaagggagaaaacaaaggagagaggaagacaggggagacacaagaaaaacaccaggagcatagcaaccccaaaccacgaagat

SEQ ID NO: 736915 - DNA, 2533 bp, Homo sapiens
  misc_feature (2254)..(2254): n is a, c, g, or t
  misc_feature (2267)..(2267): n is a, c, g, or t
  misc_feature (2269)..(2269): n is a, c, g, or t
ccggagtctcgcgcccgcggtcatgtgacacagcgaagatggcgtcgcccggcgtgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttttcagttttagaaaagggagtctgttccagatcagggccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaaaaaaaaaacaaaccacacnaacaaaaaaacananaaaaacagacggcacggaccaaaacaaagcaacaacaaccaacacaaaaagacacgaacccggaagagcacaaaacaacaagaaaaacaaaaaagaccagaaagaaagcataatatatatgcggggcaagagaccagccagaacagacagagaaaggaaaaaaaaagaaaagaaacgaaaaaaagggagaaaacaaaggagagaggaagacaggggagacacaagaaaaacaccaggagcatagcaaccccaaaccacgaagat

SEQ ID NO: 736916 - DNA, 2542 bp, Homo sapiens
  misc_feature (2263)..(2263): n is a, c, g, or t
  misc_feature (2276)..(2276): n is a, c, g, or t
  misc_feature (2278)..(2278): n is a, c, g, or t
ccggagtctcgcgcccgcggtcatgtgacacagcgaagatggcgtcgcccggcgtgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagggccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaaaaaaaaaacaaaccacacnaacaaaaaaacananaaaaacagacggcacggaccaaaacaaagcaacaacaaccaacacaaaaagacacgaacccggaagagcacaaaacaacaagaaaaacaaaaaagaccagaaagaaagcataatatatatgcggggcaagagaccagccagaacagacagagaaaggaaaaaaaaagaaaagaaacgaaaaaaagggagaaaacaaaggagagaggaagacaggggagacacaagaaaaacaccaggagcatagcaaccccaaaccacgaagat

SEQ ID NO: 736917 - DNA, 2532 bp, Homo sapiens
  misc_feature (2253)..(2253): n is a, c, g, or t
  misc_feature (2266)..(2266): n is a, c, g, or t
  misc_feature (2268)..(2268): n is a, c, g, or t
ccggagtctcgcgcccgcggtcatgtgacacagcgaagatggcgtcgcccggcctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagggccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaaaaaaaaaacaaaccacacnaacaaaaaaacananaaaaacagacggcacggaccaaaacaaagcaacaacaaccaacacaaaaagacacgaacccggaagagcacaaaacaacaagaaaaacaaaaaagaccagaaagaaagcataatatatatgcggggcaagagaccagccagaacagacagagaaaggaaaaaaaaagaaaagaaacgaaaaaaagggagaaaacaaaggagagaggaagacaggggagacacaagaaaaacaccaggagcatagcaaccccaaaccacgaagat

SEQ ID NO: 736918 - DNA, 2542 bp, Homo sapiens
  misc_feature (2263)..(2263): n is a, c, g, or t
  misc_feature (2276)..(2276): n is a, c, g, or t
  misc_feature (2278)..(2278): n is a, c, g, or t
ttgaagggttgctgactgatttcatagcatatactgttaaaatgctttgccttgtgttttcagcagcagatcatacagtgatactttcacccttgagtggctcatgtgaggataccaacctaaatgagtttacctcttagagaagatgtcagtggttgttttcagtcccatcctctcacttctctctggcttcttttttaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagggccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaaaaaaaaaacaaaccacacnaacaaaaaaacananaaaaacagacggcacggaccaaaacaaagcaacaacaaccaacacaaaaagacacgaacccggaagagcacaaaacaacaagaaaaacaaaaaagaccagaaagaaagcataatatatatgcggggcaagagaccagccagaacagacagagaaaggaaaaaaaaagaaaagaaacgaaaaaaagggagaaaacaaaggagagaggaagacaggggagacacaagaaaaacaccaggagcatagcaaccccaaaccacgaagat

SEQ ID NO: 736919 - DNA, 1704 bp, Homo sapiens
  misc_feature (35)..(35): n is a, c, g, or t
  misc_feature (1425)..(1425): n is a, c, g, or t
  misc_feature (1438)..(1438): n is a, c, g, or t
  misc_feature (1440)..(1440): n is a, c, g, or t
gtggggtcgtctagaggatcccatagcgacacgtnacattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagggccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaaaaaaaaaacaaaccacacnaacaaaaaaacananaaaaacagacggcacggaccaaaacaaagcaacaacaaccaacacaaaaagacacgaacccggaagagcacaaaacaacaagaaaaacaaaaaagaccagaaagaaagcataatatatatgcggggcaagagaccagccagaacagacagagaaaggaaaaaaaaagaaaagaaacgaaaaaaagggagaaaacaaaggagagaggaagacaggggagacacaagaaaaacaccaggagcatagcaaccccaaaccacgaagat

SEQ ID NO: 736920 - DNA, 1782 bp, Homo sapiens
  misc_feature (1503)..(1503): n is a, c, g, or t
  misc_feature (1516)..(1516): n is a, c, g, or t
  misc_feature (1518)..(1518): n is a, c, g, or t
agtccgacctccttgttctttgtgaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagggccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaaaaaaaaaacaaaccacacnaacaaaaaaacananaaaaacagacggcacggaccaaaacaaagcaacaacaaccaacacaaaaagacacgaacccggaagagcacaaaacaacaagaaaaacaaaaaagaccagaaagaaagcataatatatatgcggggcaagagaccagccagaacagacagagaaaggaaaaaaaaagaaaagaaacgaaaaaaagggagaaaacaaaggagagaggaagacaggggagacacaagaaaaacaccaggagcatagcaaccccaaaccacgaagat

SEQ ID NO: 736921 - DNA, 2623 bp, Homo sapiens
  misc_feature (53)..(54): n is a, c, g, or t
  misc_feature (57)..(57): n is a, c, g, or t
  misc_feature (2344)..(2344): n is a, c, g, or t
  misc_feature (2357)..(2357): n is a, c, g, or t
  misc_feature (2359)..(2359): n is a, c, g, or t
tcacaacacaccacaccacaccaacgaaaaaactacggctaggtagcgaggcnnggngttaggtgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagggccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaaaaaaaaaacaaaccacacnaacaaaaaaacananaaaaacagacggcacggaccaaaacaaagcaacaacaaccaacacaaaaagacacgaacccggaagagcacaaaacaacaagaaaaacaaaaaagaccagaaagaaagcataatatatatgcggggcaagagaccagccagaacagacagagaaaggaaaaaaaaagaaaagaaacgaaaaaaagggagaaaacaaaggagagaggaagacaggggagacacaagaaaaacaccaggagcatagcaaccccaaaccacgaagat

SEQ ID NO: 736922 - DNA, 930 bp, Homo sapiens
  misc_feature (897)..(897): n is a, c, g, or t
tgaaactgaacattgttttttggggttctcgatgcctgggctcaagacaaaccaaaacctttgcaaaatgagggccctaatagaactctccgtaaagctggggccccaaagggtgacaccctctgtgaactaatagcaaatctgccctcctggcatcccatacaaaagttaaaccttgccacttactggactgaaaaaaaggtcttccttgagaactgagccaaccttcatgtgggtttttgtacatgagaatccaagaatttaagtggtcccactggtcccagaatgttggaagtctcaaacacttgatagaagaaaatgtagatcctacctggacaaagctttattcatatcagctctcaaagaattctccctgataaagtttcaagacatatgagaatcttagggcctactcagtgaccctggatggacaatgaccctcaaggatcatccccaaacatgacctgggccacttcatgatgtactgcctcaccgctgctgagtatgatgggcacagcacctgtccctccccacagtgcgactaggagtctggccccatgtaggacgatagcttgctgggaaatgagcatcaaaggaagggagcaatacattttgagccaagagctttaagttatttttaaaatagaaaagagaaacgaacaggttgcagaaaagctcatcagacacacaaggtaacagagcctcaggtgcaaaataaccaacatcgaaaatcacatggtagaaccagacttatgaagacttcagacatcagaattatcagccatggaatttaggtatgtttaaaaattacttaagaactaaaagatgtgaacataggagcagatttgcaaaagaaccaaaccagtattctggaaataaaaaatacagtagtctggnccccacccctggcatctccaatttccctttctg

SEQ ID NO: 736923 - DNA, 2386 bp, Homo sapiens
  misc_feature (2099)..(2099): n is a, c, g, or t
agcgggggaacggattctccggagccgaggtccgctcggatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcattgctctgatcttcgaaaacatgagagaactcacactggagagaagccatatggatgtcatctatgtgggaaagccttcagtaaaagttctaaccttagacgacatgagatgattcacactagagaaaaagcacagatatgccatctatgtgggaaagccttcactcattgctctgaccttagaaaacatgagagaactcacttaggagataaaccatatggatgtctcctatgtgggaaggctttcagtaaatgttcttaccttagacaacatgaaagaactcacaatggagagaaaccatatgaatgtcatctatgtggaaaagccttctctcattgttctcaccttagacaacatgagcgaagtcacaatggagagaaaccacatggatgtcatctatgtgggaaagcattcactgaatcttctgtgcttaaacgacatgagagaattcacactggagagaaaccatatgagtgccatgtatgtgggaaagccttcactgaatcttctgacctcagacgacatgagagaactcacactggagaaaaaccatatgaatgccatctatgcggaaaagccttcaatcactcttctgtccttagacgacatgagagaactcacactggagagaaaccatatgaatgcaatatatgtggtaaagccttcaatagaagttacaactttagacttcatagaagagttcacactggagagaaaccatatgtatgtcctctatgtgggaaagcctttagtaaattttttaaccttagacaacatgagagaactcacactaaaaaagcaatgaatatgtaagaatcatcagctgtagcgttaacactaaatacaccaaggacaaacatactacaggaatattatgtctgtaatcagtgtggaaaagcctttatttatatttaccactttgctcaacctaaatgaattcaaggtagagagaatccagatgtatttaatgtttatggcacaaacttcagactctaggctgaccatatacaacgtgagagaatgaaactatagatcaaaggaatgtggaggagtcttcatccacagctctgttaaataaatgggagaaatcacatcacgaaaattctgtgcctgtcgtcagtgtgaaaatgcctttgctgataatttatcctctaaacaaatgagtaaaatccacaggcaagcaaccatatgtctgtaattgctgtgcactctcattcagctaagcaccaattttggtgtgtgcaagaaaattcattataaggtaactgataaaaacaggaaatatgtgaaaatattttttattaggtggatgaggcctcttgaacaattccagacattcatagtggagaagttattcaatgaaaactcatgagaaatccttttcttaatacagcagcacttctataatagatcagaattcacatggtgtagaactctcaatgacatgaatggagggtagtcctcagtaaattactcattccttagtcaataccagnatttttccagtgagaaaactatcttgacaggatagtggaaaaaccttcaggcagcttttatgtcaaaaaagtgagacagggatgaaaactctaaaaagccattgatgagatgtatagctgggggacaaaacataaagccatcaagcacgtgcttgagaaaaaaattataattttgaataaagactttctacttaaaatatgtgggttgaaatgtacaattctgaaataacctgggaatattgaatgcagaattatgtaagaagtaataagattaaattagtactgtc

SEQ ID NO: 736924 - DNA, 2596 bp, Homo sapiens
  misc_feature (2309)..(2309): n is a, c, g, or t
agcgggggaacggattctccggagccgaggtccgctcggatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtagagaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcattgctctgatcttcgaaaacatgagagaactcacactggagagaagccatatggatgtcatctatgtgggaaagccttcagtaaaagttctaaccttagacgacatgagatgattcacactagagaaaaagcacagatatgccatctatgtgggaaagccttcactcattgctctgaccttagaaaacatgagagaactcacttaggagataaaccatatggatgtctcctatgtgggaaggctttcagtaaatgttcttaccttagacaacatgaaagaactcacaatggagagaaaccatatgaatgtcatctatgtggaaaagccttctctcattgttctcaccttagacaacatgagcgaagtcacaatggagagaaaccacatggatgtcatctatgtgggaaagcattcactgaatcttctgtgcttaaacgacatgagagaattcacactggagagaaaccatatgagtgccatgtatgtgggaaagccttcactgaatcttctgacctcagacgacatgagagaactcacactggagaaaaaccatatgaatgccatctatgcggaaaagccttcaatcactcttctgtccttagacgacatgagagaactcacactggagagaaaccatatgaatgcaatatatgtggtaaagccttcaatagaagttacaactttagacttcatagaagagttcacactggagagaaaccatatgtatgtcctctatgtgggaaagcctttagtaaattttttaaccttagacaacatgagagaactcacactaaaaaagcaatgaatatgtaagaatcatcagctgtagcgttaacactaaatacaccaaggacaaacatactacaggaatattatgtctgtaatcagtgtggaaaagcctttatttatatttaccactttgctcaacctaaatgaattcaaggtagagagaatccagatgtatttaatgtttatggcacaaacttcagactctaggctgaccatatacaacgtgagagaatgaaactatagatcaaaggaatgtggaggagtcttcatccacagctctgttaaataaatgggagaaatcacatcacgaaaattctgtgcctgtcgtcagtgtgaaaatgcctttgctgataatttatcctctaaacaaatgagtaaaatccacaggcaagcaaccatatgtctgtaattgctgtgcactctcattcagctaagcaccaattttggtgtgtgcaagaaaattcattataaggtaactgataaaaacaggaaatatgtgaaaatattttttattaggtggatgaggcctcttgaacaattccagacattcatagtggagaagttattcaatgaaaactcatgagaaatccttttcttaatacagcagcacttctataatagatcagaattcacatggtgtagaactctcaatgacatgaatggagggtagtcctcagtaaattactcattccttagtcaataccagnatttttccagtgagaaaactatcttgacaggatagtggaaaaaccttcaggcagcttttatgtcaaaaaagtgagacagggatgaaaactctaaaaagccattgatgagatgtatagctgggggacaaaacataaagccatcaagcacgtgcttgagaaaaaaattataattttgaataaagactttctacttaaaatatgtgggttgaaatgtacaattctgaaataacctgggaatattgaatgcagaattatgtaagaagtaataagattaaattagtactgtc

SEQ ID NO: 736925 - DNA, 1587 bp, Homo sapiens
agcgggggaacggattctccggagccgaggtccgctcggatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtagagaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcattgctctgatcttcgaaaacatgagagaactcacactggagagaagccatatggatgtcatctatgtgggaaagccttcagtaaaagttctaaccttagacgacatgagatgattcacactagagaaaaagcacagatatgccatctatgtgggaaagccttcactcattgctctgaccttagaaaacatgagagaactcacttaggagataaaccatatggatgtctcctatgtgggaaggctttcagtaaatgttcttaccttagacaacatgaaagaactcacaatggagagaaaccatatgaatgtcatctatgtggaaaagccttctctcattgttctcaccttagacaacatgagcgaagtcacaatggagagaaaccacatggatgtcatctatgtgggaaagcattcactgaatcttctgtgcttaaacgacatgagagaattcacactggagagaaaccatatgagtgccatgtatgtgggaaagccttcactgaatcttctgacctcagacgacatgagagaactcacactggagaaaaaccatatgaatgccatctatgcggaaaagccttcaatcactcttctgtccttagacgacatgagagaactcacactggagagaaaccatatgaatgcaatatatgtggtaaagccttcaatagaagttacaactttagacttcatagaagagttcacactggagagaaaccaacacaggcaacatagtctgaaggtgtagaaatgacgggatcctctagatgcgac

SEQ ID NO: 736926 - DNA, 2009 bp, Homo sapiens
  misc_feature (1722)..(1722): n is a, c, g, or t
agcgggggaacggattctccggagccgaggtccgctcggatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtagagaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcattgctctgatcttcgaaaacatgagagaactcacaactggagagaaaccatatgaatgcaatatatgtggtaaagccttcaatagaagttacaactttagacttcatagaagagttcacactggagagaaaccatatgtatgtcctctatgtgggaaagcctttagtaaattttttaaccttagacaacatgagagaactcacactaaaaaagcaatgaatatgtaagaatcatcagctgtagcgttaacactaaatacaccaaggacaaacatactacaggaatattatgtctgtaatcagtgtggaaaagcctttatttatatttaccactttgctcaacctaaatgaattcaaggtagagagaatccagatgtatttaatgtttatggcacaaacttcagactctaggctgaccatatacaacgtgagagaatgaaactatagatcaaaggaatgtggaggagtcttcatccacagctctgttaaataaatgggagaaatcacatcacgaaaattctgtgcctgtcgtcagtgtgaaaatgcctttgctgataatttatcctctaaacaaatgagtaaaatccacaggcaagcaaccatatgtctgtaattgctgtgcactctcattcagctaagcaccaattttggtgtgtgcaagaaaattcattataaggtaactgataaaaacaggaaatatgtgaaaatattttttattaggtggatgaggcctcttgaacaattccagacattcatagtggagaagttattcaatgaaaactcatgagaaatccttttcttaatacagcagcacttctataatagatcagaattcacatggtgtagaactctcaatgacatgaatggagggtagtcctcagtaaattactcattccttagtcaataccagnatttttccagtgagaaaactatcttgacaggatagtggaaaaaccttcaggcagcttttatgtcaaaaaagtgagacagggatgaaaactctaaaaagccattgatgagatgtatagctgggggacaaaacataaagccatcaagcacgtgcttgagaaaaaaattataattttgaataaagactttctacttaaaatatgtgggttgaaatgtacaattctgaaataacctgggaatattgaatgcagaattatgtaagaagtaataagattaaattagtactgtc

SEQ ID NO: 736927 - DNA, 1345 bp, Homo sapiens
ccccccccacacggtggggagtttctattggcccgggggatttgggaacccaagagccgtggttgggcccccccccccccccccgggccaaacccccaaacttttccccaaagaagagaagacaaaaaaaaaaaaagattgaacagctctttttcatttttgttttgttcattttatacatgacacaaattgtttatcttgctctcattgggagtttctgttgattccctctttcaatgatcatcaaaagtcatcacccctgacttaaatggttttatgaaattcaagaagttgtgaacaaggctttaacaaaatatttccacttttaatgcctatgctctgattttatataaattttgtatgtaggacatgatgttgaagtaaaaccaataaatagccactcagtattcatctctagcgtcaactgaatcctgacctcaatcttcaaaagaatcagaatagtttcacacttcataagttacatatactccagaataaataaaagcagtttgcttgaagtattatcttggctcatttgtgctgctataacaaaacacacttgagactgggttatttataaagaacagaaatttatttctctacagttctggaggctgggaagtccaagatcaagctgcaagcagattcggtgtctggtgagggctgctgtgtgctttcaaggtggtgccttattgctgtgtctttatatggcagaaggggccaacaatggagaaacagcagaatagcaagaagcagctgaatgctatgtgatgcttcttttataagggccttaaatcccattcatgaaagagaagccttcataatccaatcacctcctaaaggccctacctcttaatattgaagattaagtttcaacatgaattttggaggtacgtattcaaaccatagcaagcatacagtaatttccaatataaacctcactcaaaattacagtcacatgctgcacaaaccagttcaatgcacatatatgatgataagattataatacaatatttttgctatactttttctatgtttacatatacagatatcattgtgttacaattgcctttagtattcagtacagtaacatgctgtacaggtttgtagcctaggagcaatagatcatactttcaagcctaccatctagatttatataattacactctgtgatgttcgctcagtgatgaaatcacctgagaacacgtttctcagatcatatccctgttgttaagcaatgtgactgcaattgtgctctgctgccagtttatttttgaagctttatttttcaattacttactcatggcaattttataagaatcattaaacaaatttaatccagcta

SEQ ID NO: 736928 - DNA, 1869 bp, Homo sapiens
agaaaatgtgctttgcaaagcaaaaaaggcaaaaattggggatgagttcttcagacaagtaccaaaaatgatttctcgtcatttttaatgtatgcatattcatcatagaaaataattttttgttttattgggaataaaatcatgatacttaaaatctgatacacatttcaatgatcgtattaatccaataggttaaattaacaaattcttaggaaaaaaatctgtttatatgaagctatggagaaatctagaaagtaggtaatggtttagattttgagggacctatgaactcagaacaagttcatttagaggtgggaaacctgagattcaaagaggtctgcatggctgccaagattgcagggacagaatccaagcctgggctcactcatgatctgctctcctgtataaatgtcccatgtgcatctatgaccttattgtttgcaaagcaaattcatattccacgacttgtctgcttcttacaacaaactacaaggcaggcattgtgatttctaagtaagaaggaaaaattaagtagtcaagataatatttagaataaatatttttgaagatgatagttaaatagatggctcttcagactcctagctcaggctatttttccagccttcttttcccaaggaagagaagacaaaaaaaaaaaaagattgaacagctctttttcatttttgttttgttcattttatacatgacacaaattgtttatcttgctctcattgggagtttctgttgattccctctttcaatgatcatcaaaagtcatcacccctgacttaaatggttttatgaaattcaagaagttgtgaacaaggctttaacaaaatatttccacttttaatgcctatgctctgattttatataaattttgtatgtaggacatgatgttgaagtaaaaccaataaatagccactcagtattcatctctagcgtcaactgaatcctgacctcaatcttcaaaagaatcagaatagtttcacacttcataagttacatatactccagaataaataaaagcagtttgcttgaagtattatcttggctcatttgtgctgctataacaaaacacacttgagactgggttatttataaagaacagaaatttatttctctacagttctggaggctgggaagtccaagatcaagctgcaagcagattcggtgtctggtgagggctgctgtgtgctttcaaggtggtgccttattgctgtgtctttatatggcagaaggggccaacaatggagaaacagcagaatagcaagaagcagctgaatgctatgtgatgcttcttttataagggccttaaatcccattcatgaaagagaagccttcataatccaatcacctcctaaaggccctacctcttaatattgaagattaagtttcaacatgaattttggaggtacgtattcaaaccatagcaagcatacagtaatttccaatataaacctcactcaaaattacagtcacatgctgcacaaaccagttcaatgcacatatatgatgataagattataatacaatatttttgctatactttttctatgtttacatatacagatatcattgtgttacaattgcctttagtattcagtacagtaacatgctgtacaggtttgtagcctaggagcaatagatcatactttcaagcctaccatctagatttatataattacactctgtgatgttcgctcagtgatgaaatcacctgagaacacgtttctcagatcatatccctgttgttaagcaatgtgactgcaattgtgctctgctgccagtttatttttgaagctttatttttcaattacttactcatggcaattttataagaatcattaaacaaatttaatccagcta

SEQ ID NO: 736929 - DNA, 963 bp, Homo sapiens; identical to SEQ ID NO: 98089
  misc_feature (869)..(869): n is a, c, g, or t
  misc_feature (959)..(959): n is a, c, g, or t

SEQ ID NO: 736930 - DNA, 774 bp, Homo sapiens; identical to SEQ ID NO: 436366

SEQ ID NO: 736931 - DNA, 900 bp, Homo sapiens
gaccgttggtgtgcgtgttagctcgtgaaatatggaggatgtagattgggggtgcgggtgggctggggggtgggggaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcactccagcctaggcgacagagcaaaactgtctca

SEQ ID NO: 736932 - DNA, 6843 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttgagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtggtctaaattcttgatactgtttataattctacaaagaacaaaaattgttacgtactataggcacttaagaaccctgaggaaaaataatacaatgtgtgtgtgtgagagagagagtgagttactgacattgttccaaaaaaaaaaaaaaaaaaaaaaaaatgtggagggttgaaatggtaaggaattggaatcttttgtattttcgagcaataagaattcctattcttgtttcaaatagaggtttgttaggaattacagttgtggggagcaaactttcttttttgtgctgttttaatccaaaatgtatatccttaattgtatataatatgtagataaatatatgagggtattaagctactttgaattaaatttaaggatatatttcacatgaaaacaaatacaaacttgagaatcaaaataaagttttgcaaagtatttctttg

SEQ ID NO: 736933 - DNA, 6452 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttgagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtagaattataaacagtatcaagaatttagaccacaaagtcagtcgacgcggccg

SEQ ID NO: 736934 - DNA, 1708 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgataaaaaaaaaaaaaaaaaaaaaaaaaaacaaaaaaaaaaaaaaaaaaaaaaaaaaaaaaaaacaaaaaaa

SEQ ID NO: 736935 - DNA, 1663 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgataaaaacaaaaacacacaaaacaca

SEQ ID NO: 736936 - DNA, 1666 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaacagatgcggcagttctctttctccgtcccggtgatcaaggtgttgatttat

SEQ ID NO: 736937 - DNA, 1665 bp, Homo sapiens
  misc_feature (1634)..(1635): n is a, c, g, or t
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaacagatgcggccgacttatnnacaacttacaacctaacactctattcatat

SEQ ID NO: 736938 - DNA, 1615 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacgtaaccctgggttaacaacaaatatctcggttcctctc

SEQ ID NO: 736939 - DNA, 1659 bp, Homo sapiens; identical to SEQ ID NO: 436392

SEQ ID NO: 736940 - DNA, 1670 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctccttaacttgaatacagcgaaatttctacccgtggaagactatgagggtttacctaaacggtctggttaataaaaaaaaaggggggcaaaacaagggaaaacgacacttgaagccagagaatataggcggtaagggaggtgttgaactggggaccaaacatagatgtgctaa

SEQ ID NO: 736941 - DNA, 1316 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcatagagaggtgtgacatgagtcttttgattctaataagaagggttcggggggaaacaggccaatggcatgagtg

SEQ ID NO: 736942 - DNA, 865 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcatcatttctccctgaagtcgagcggccgttaatttagtagtag

SEQ ID NO: 736943 - DNA, 760 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaattctctcggaccaatgggtaccgt

SEQ ID NO: 736944 - DNA, 6978 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgggtataactccaccagggaatgctccgactgtcacttcaatgagcagcatcaacaacacagttgcaacacctgccagttatcacacgaaggatgaccccaggggactcagtgtgttgaaacaggagaaacagaagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttgagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtggtctaaattcttgatactgtttataattctacaaagaacaaaaattgttacgtactataggcacttaagaaccctgaggaaaaataatacaatgtgtgtgtgtgagagagagagtgagttactgacattgttccaaaaaaaaaaaaaaaaaaaaaaaaatgtggagggttgaaatggtaaggaattggaatcttttgtattttcgagcaataagaattcctattcttgtttcaaatagaggtttgttaggaattacagttgtggggagcaaactttcttttttgtgctgttttaatccaaaatgtatatccttaattgtatataatatgtagataaatatatgagggtattaagctactttgaattaaatttaaggatatatttcacatgaaaacaaatacaaacttgagaatcaaaataaagttttgcaaagtatttctttg

SEQ ID NO: 736945 - DNA, 6505 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttgagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtggtctaaattcttgatactgtttataattctacaaagaacaaaaattgttacgtactataggcacttaagaaccctgaggaaaaataatacaatgtgtgtgtgtgagagagagagtgagttactgacattgttccaaaaaaaaaaaaaaaaaaaaaaaaatgtggagggttgaaatggtaaggaattggaatcttttgtattttcgagcaataagaattcctattcttgtttcaaatagaggtttgttaggaattacagttgtggggagcaaactttcttttttgtgctgttttaatccaaaatgtatatccttaattgtatataatatgtagataaatatatgagggtattaagctactttgaattaaatttaaggatatatttcacatgaaaacaaatacaaacttgagaatcaaaataaagttttgcaaagtatttctttg

SEQ ID NO: 736946 - DNA, 6540 bp, Homo sapiens
agtgcgtttacaaatttctttgaatagaagtgtaagtgagctacttgttgggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttgagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtggtctaaattcttgatactgtttataattctacaaagaacaaaaattgttacgtactataggcacttaagaaccctgaggaaaaataatacaatgtgtgtgtgtgagagagagagtgagttactgacattgttccaaaaaaaaaaaaaaaaaaaaaaaaatgtggagggttgaaatggtaaggaattggaatcttttgtattttcgagcaataagaattcctattcttgtttcaaatagaggtttgttaggaattacagttgtggggagcaaactttcttttttgtgctgttttaatccaaaatgtatatccttaattgtatataatatgtagataaatatatgagggtattaagctactttgaattaaatttaaggatatatttcacatgaaaacaaatacaaacttgagaatcaaaataaagttttgcaaagtatttctttg

SEQ ID NO: 736947 - DNA, 6514 bp, Homo sapiens
tctctttaatttttaaactttacaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttgagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtggtctaaattcttgatactgtttataattctacaaagaacaaaaattgttacgtactataggcacttaagaaccctgaggaaaaataatacaatgtgtgtgtgtgagagagagagtgagttactgacattgttccaaaaaaaaaaaaaaaaaaaaaaaaatgtggagggttgaaatggtaaggaattggaatcttttgtattttcgagcaataagaattcctattcttgtttcaaatagaggtttgttaggaattacagttgtggggagcaaactttcttttttgtgctgttttaatccaaaatgtatatccttaattgtatataatatgtagataaatatatgagggtattaagctactttgaattaaatttaaggatatatttcacatgaaaacaaatacaaacttgagaatcaaaataaagttttgcaaagtatttctttg

SEQ ID NO: 736948 - DNA, 6187 bp, Homo sapiens
gttagttaaaaaattcccaatatctttgtaatgcagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttgagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtggtctaaattcttgatactgtttataattctacaaagaacaaaaattgttacgtactataggcacttaagaaccctgaggaaaaataatacaatgtgtgtgtgtgagagagagagtgagttactgacattgttccaaaaaaaaaaaaaaaaaaaaaaaaatgtggagggttgaaatggtaaggaattggaatcttttgtattttcgagcaataagaattcctattcttgtttcaaatagaggtttgttaggaattacagttgtggggagcaaactttcttttttgtgctgttttaatccaaaatgtatatccttaattgtatataatatgtagataaatatatgagggtattaagctactttgaattaaatttaaggatatatttcacatgaaaacaaatacaaacttgagaatcaaaataaagttttgcaaagtatttctttg

SEQ ID NO: 736949 - DNA, 773 bp, Homo sapiens
tgagatgagtctcaaaaacaaaaacaaacaaaaaagaaacctggtatgtaagtagctaaatatagagacgtataggaggcatcttgtaatgtgtgattattcatttgattttattcagtgtgctattaagaagggcccttccttctaaagaaaattagaacattttcaaagcttgcgtctgaatcctgtctcactactcagtaatggagtgacccaggaaaccgcatcacctccccaagccccagtccctgtgaaatggggagtgtagtaagacctgcttcctagggctgttgggaggatcaggtgagacaatctgattgaaggacttggaccagtgcctgataaataataagcacttggtaagttattattagggctgggagagcaataacttcagctgcgaaagctaatactagtctatcctgatgacggcatcagatacttattttcaagtttcttctgaagacaaattttaattgacacttgaaaaccaggaagagcatgaaaaagaggactcagtgtagcctctaaaggctgttgagcctgaagaggtgttggaatgccgtgcccgccttgtgttgcaggcttcagcagtttaggcccagaggactgtgggtcccacctgcctgacagcagggcacacaggtgctgagcagttggccattactgggctgtgaaaacagcatgaatggggaatggagactgtgggcaaagcagtacagtccacttgttcgcaggtgggaaagtcaaactctgtctttattctttttttt

SEQ ID NO: 736950 - DNA, 696 bp, Homo sapiens
gagatggagtcttgctctgtcaccgaggctggagtgcagtgtgtgctattaagaagggcccttccttctaaagaaaattagaacattttcaaagcttgcgtctgaatcctgtctcactactcagtaatggagtgacccaggaaaccgcatcacctccccaagccccagtccctgtgaaatggggagtgtagtaagacctgcttcctagggctgttgggaggatcaggtgagacaatctgattgaaggacttggaccagtgcctgataaataataagcacttggtaagttattattagggctgggagagcaataacttcagctgcgaaagctaatactagtctatcctgatgacggcatcagatacttattttcaagtttcttctgaagacaaattttaattgacacttgaaaaccaggaagagcatgaaaaagaggactcagtgtagcctctaaaggctgttgagcctgaagaggtgttggaatgccgtgcccgccttgtgttgcaggcttcagcagtttaggcccagaggactgtgggtcccacctgcctgacagcagggcacacaggtgctgagcagttggccattactgggctgtgaaaacagcatgaatggggaatggagactgtgggcaaagcagtacagtccacttgttcgcaggtgggaaagtcaaactctgtctttattctttttttt

SEQ ID NO: 736951 - DNA, 961 bp, Homo sapiens
tatatttaatcattctctttggctcacaacagcagtccagtccaaagatttactttttctattttcaaccccatcattatttttgtgtaaaaagtatgttttgagttacagcaattcatggagatcaagcttctactctgtagggagaagagagatgtcatttactacagagtttatacacacaaatgttctgctgcatgctgtgttcccactgaaatccagggggtttatttgcatttatacttaaagaagaatgaccgtatttggctgactctaagccaagatgatacaggcccaaagtttttcatggaggaatgggggagtaagggaaataggaacatttggaagaaatagttgttgtttttccctgttttattcagtgggcattttattcacagatcatttgatgcattgcatttactcgtgttattctggttccttttgtgttttttttttccttttgaaacaacttcacacttacaggaaaatggcaaaaatactaaaataagaactcctataaaccttcactgataaaatcccttcagttttctccagttatcccagtaacgtcctttatagcaaaaggatccggttcaggatcactcatacccagctgtcatatctttccagtctccttcattctagaagcattcttcattcttccttcatctttcatgacactgacacttttaattacaggccagctgatgtgtagaatgtccttccttttcttaggagatgttttctgtccttccttgaaaaccccactagtgttacctgccacgaggagagctaggcgctctgccccctaccccaagctggttgctctctcttacaacgcttcattaatcaagtacccttttttggagcattgatgatattcattcatccttttagccagtaaatattttttgatgtctattacgtgccaaatgggatacatttaagaacaaagcagacc

SEQ ID NO: 736952 - DNA, 914 bp, Homo sapiens
  misc_feature (296)..(296): n is a, c, g, or t
gggtcttgctctgtggcccatggtgcagtgcagtgcagtggtgctatcagctcactgcagtctcaaactcctagctcaagcaatcctcctccctcagcctcccaagtaggtaggactacagatatatgccaccacgtccagcaaattttgtttgtttgtagagatggggtcttgctatatttcccaggcttgtctcaaactcctggcctcaagtgatcctcccaccttggctgcctaaagtgctggtattacagacatgagccactgaacccagctgagagcctcactttcatcanctgtgctgtgaggggtaatatatgcttcaggttttctggagaatccttcttgcagagaagtttctgaatgaaacgacagattcatctggattcagaactccaggcagaagctgcttaacagcaaaaatctggcatcttcactacattttaagattttaggtagaactaagagggatcagatatagaggaataaggaatgtgagaaggaaaaagatatagtagtttagctaaatttttcttagagtttcttggtggggctggccatgaagtaactagtctgactcatttcttctgggaaggctaaaagagacacaaatagcttctcttttaccttggctttaaggaaaagccattttattaacaaaagtattagacacgactgcataagaaatttgctgtgtgagaataaagaacaagggagtaggagggtgggacagagaagggtgagaagttggcttcgtgagggccacctgtcagttgtctttgtgccttgtgacatcaaaactgaaatgtttgtattactgttgtccatgactttttttttctgtgtcagacatacaaattgaatttggttgtaatgttttaaacgtaataaagaattcttacctacaaaaaaaa

SEQ ID NO: 736953 - DNA, 6405 bp, Homo sapiens
gggcggcgcggaggggcagggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcaactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcaggatataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagacgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcgtgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataagaaaaatgtaagcttatttcataaacatttaaagctgattcagaacatgttaaaaactgttcccaattccaactatgtaaatagatcctatgttcacattttacacacacacacaaaaatctttaacatctgtggaacttcccagttttagtcttagaaagttagcatgttgcataagttcagtaatcctcaggaacctccaagtttacttttagctcttacggacagttgtttacataatctaattactgttttctgaagaacggaaattatataagctgctgtctgccttttggaatattcagaaaagcagattttatttgtacttctgtgatgttttctgaaatggaaagctgatgataaatatcaaagtagcaatcagtgcgttaaattattctgttacatgatatttattactgttgaattattctgtgacttagaaatggcagtaacctaaataatggaatttgcaaaattattatattgccgtatctgagatgttccatcacaagtttctacactggtttcttttgaaaatttaaaaagatttacgagatacattttctaggatatgattttttttttacaaaaagcttcatcttctgtagactatccttaatttctattttgaaacggtaaaaattgatattttaggacaccaggaagtctccaagccattcccactctctgaactccagtagggtctgtgatgtcccaggcaccagtaccaagttggatgtgcagatatgcataggcaggtcccatccttgaggacttcagagtccagtaaaaggcagcagaaacatgggctggtgcctaagaggagaaagcgtagccacagtaaaggctatgccagaaaactcctagcaaatgctctgtgttcttgggagagggcacattgtttttgttttctctcctatagttcctgtaactgctggttttgagaatatagtaatcatttttcccagaggcagatgaccaccttaaggttctttagctgcaaatcctctaggttgaagtttgtgtgaaatagtcacagtgattttgaatagtaaggaatccagttgccttttgaaccttccctcacagggatgagagaacaagcctgtggaggttgtggagctactggtaaacaactgtcagggccccagaaggctgatgtggaggcctggggatacatttcatctaataaaagtattactaggtatcagtatcagtaataaaagtattataataaagtatcagtaataaaagtattataataaaaagtattattaggacaggtaaactcatccatctactgtgagctgctggcttggagaacgacttttgaggagccagtttcctgaggagaaatgcttttataaagcactcattgctttgtaaaaggagacaaaactgatcctaaatgaccactccagggttgctgattttgtttctggctcatgtctgcctagtaaaccaccagcaagctgctgaaccaggctggaaacaacattgttgcaactgggagggacatagagtactgtgaaagcagcgttccaacacatcttcacttttacaaagggataggcagagacttccaacatagaggttcttaaacttcgaggggttacaatccccttgcaaatatttttatagctatggaccctctcctcagatctacagccaacattttcagtgcaccttaggaggtcattttagtccacgcctctgaaaaagctgcactccaacggctgaagagcaagccatacggccgagaatggggctccctttgccttcatgaaagctacttcccccaacactaagactcagctgtacgtttgcttagctcagtcacatttacattcttctgggtgaactgtaccttttgagtacctgccttcattttctagaatcagacctaacaaggtcagtagaagcctgggcagcagcgggcctggaaagacgaggcagccagcatgaactgctgttctctccctgaccacaaggcgtcgtcttcctccagggtcaagtaattgttcttgttccgcctcacaggaatgtggggaggaaggacgttaacactataaaatgctgcgtcctaccttaaacttgtactgtgagaaagctggaaacttccacctgtacagtgggtctggtttgcatgtttagtttcatttgtgggaactgcttgtccaagagtgagctcaggtcagggcagtttgtgcctatgagaattagctcagctatcaggcaggtttttagacacctttttaaaatgtgctcgtgtttggtttgttttgcttactgtcagtcctgggtcaatcaaaggtttgtaagggtgagaatttttatgcactgctatatcgcaagtgcttaaaacagagactggcccagatgaggcattcttcaaatgtttgttgaaatgaatggacaaactcttaggataaatcctaatttgttggcaactgttatttgattttagaaggcaaactgattttattttagagaggggaaggggaggggaggctcattagcctcttggtagaaagaggactatttctgcaaatgaataggtttccaccttaagtagtgacagtccttaacttcttattatggagtgagtcttgaccgctttccaagttcaatagaagttcaagattgcctctcagtgattagggaaattgaagcttttaaagctcctggtctcagtaattcctcagaataaacctctttaaaagggatattgatggaaatgtacaattaccagtaattgaggttttatctgaggggatggagatgatgaaatggttccttcttggaagttgttggcattttggctttatttttcacaaataaagtgaaaccatttaaaacgattgacaacgattatatagtgccatgtggaatacaatagatattaatttgtggttggtttttctgcctgctttaaatgaaatgtattatgtttctgggttccttttttagctgtaaaaatacttcgtcactaaagcatgaaatttaatcagcagttgttcttcaagttcctgaaagctataaaagtttctcatgacttgagtggttttttccctgcccaccagaggagaaagcccttgtagaattctgcagtgttacaagtgttccctacaaaaactgaaaccatcagctcctctttaacaagttggctttttaaaagcacgtaattacaatttaatggtattctgtaaagtggtgctctaggcataatttaaattctttttaatgactatatttcttcaaaactttgaaagaaaaatgtgttctttttgctgcatcctttgtaagaagactgccaacagaggaaaaaggactttacaaattaagaccatcttggtttcatttccacaaagatgagaacaaatcatggtgttaggaaaggatccttagaagaacacaagaatttgaaagcccttggtggttatcactactatatttcatatttccacagaagtgacttagccaagctctgcattttgagcctgctgactttcatttaaaaggaatgaaaggctgaaaatccaggctgctgtgtctgtagataaaggtcaaaccatgtttgagttcttcactgttgtgtccacctaaataaaactgagtaagtaatgaaaaaaagtcttaata

SEQ ID NO: 736954 - DNA, 3989 bp, Homo sapiens
ggcggccgctcgcgatctagagacggcagagctccaaggtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaaaattctagcactggtggagaattatagaataaagattataaatggttggataagaaaaatgtaagcttatttcataaacatttaaagctgattcagaacatgttaaaaactgttcccaattccaactatgtaaatagatcctatgttcacattttacacacacacacaaaaatctttaacatctgtggaacttcccagttttagtcttagaaagttagcatgttgcataagttcagtaatcctcaggaacctccaagtttacttttagctcttacggacagttgtttacataatctaattactgttttctgaagaacggaaattatataagctgctgtctgccttttggaatattcagaaaagcagattttatttgtacttctgtgatgttttctgaaatggaaagctgatgataaatatcaaagtagcaatcagtgcgttaaattattctgttacatgatatttattactgttgaattattctgtgacttagaaatggcagtaacctaaataatggaatttgcaaaattattatattgccgtatctgagatgttccatcacaagtttctacactggtttcttttgaaaatttaaaaagatttacgagatacattttctaggatatgattttttttttacaaaaagcttcatcttctgtagactatccttaatttctattttgaaacggtaaaaattgatattttaggacaccaggaagtctccaagccattcccactctctgaactccagtagggtctgtgatgtcccaggcaccagtaccaagttggatgtgcagatatgcataggcaggtcccatccttgaggacttcagagtccagtaaaaggcagcagaaacatgggctggtgcctaagaggagaaagcgtagccacagtaaaggctatgccagaaaactcctagcaaatgctctgtgttcttgggagagggcacattgtttttgttttctctcctatagttcctgtaactgctggttttgagaatatagtaatcatttttcccagaggcagatgaccaccttaaggttctttagctgcaaatcctctaggttgaagtttgtgtgaaatagtcacagtgattttgaatagtaaggaatccagttgccttttgaaccttccctcacagggatgagagaacaagcctgtggaggttgtggagctactggtaaacaactgtcagggccccagaaggctgatgtggaggcctggggatacatttcatctaataaaagtattactaggtatcagtatcagtaataaaagtattataataaagtatcagtaataaaagtattataataaaaagtattattaggacaggtaaactcatccatctactgtgagctgctggcttggagaacgacttttgaggagccagtttcctgaggagaaatgcttttataaagcactcattgctttgtaaaaggagacaaaactgatcctaaatgaccactccagggttgctgattttgtttctggctcatgtctgcctagtaaaccaccagcaagctgctgaaccaggctggaaacaacattgttgcaactgggagggacatagagtactgtgaaagcagcgttccaacacatcttcacttttacaaagggataggcagagacttccaacatagaggttcttaaacttcgaggggttacaatccccttgcaaatatttttatagctatggaccctctcctcagatctacagccaacattttcagtgcaccttaggaggtcattttagtccacgcctctgaaaaagctgcactccaacggctgaagagcaagccatacggccgagaatggggctccctttgccttcatgaaagctacttcccccaacactaagactcagctgtacgtttgcttagctcagtcacatttacattcttctgggtgaactgtaccttttgagtacctgccttcattttctagaatcagacctaacaaggtcagtagaagcctgggcagcagcgggcctggaaagacgaggcagccagcatgaactgctgttctctccctgaccacaaggcgtcgtcttcctccagggtcaagtaattgttcttgttccgcctcacaggaatgtggggaggaaggacgttaacactataaaatgctgcgtcctaccttaaacttgtactgtgagaaagctggaaacttccacctgtacagtgggtctggtttgcatgtttagtttcatttgtgggaactgcttgtccaagagtgagctcaggtcagggcagtttgtgcctatgagaattagctcagctatcaggcaggtttttagacacctttttaaaatgtgctcgtgtttggtttgttttgcttactgtcagtcctgggtcaatcaaaggtttgtaagggtgagaatttttatgcactgctatatcgcaagtgcttaaaacagagactggcccagatgaggcattcttcaaatgtttgttgaaatgaatggacaaactcttaggataaatcctaatttgttggcaactgttatttgattttagaaggcaaactgattttattttagagaggggaaggggaggggaggctcattagcctcttggtagaaagaggactatttctgcaaatgaataggtttccaccttaagtagtgacagtccttaacttcttattatggagtgagtcttgaccgctttccaagttcaatagaagttcaagattgcctctcagtgattagggaaattgaagcttttaaagctcctggtctcagtaattcctcagaataaacctctttaaaagggatattgatggaaatgtacaattaccagtaattgaggttttatctgaggggatggagatgatgaaatggttccttcttggaagttgttggcattttggctttatttttcacaaataaagtgaaaccatttaaaacgattgacaacgattatatagtgccatgtggaatacaatagatattaatttgtggttggtttttctgcctgctttaaatgaaatgtattatgtttctgggttccttttttagctgtaaaaatacttcgtcactaaagcatgaaatttaatcagcagttgttcttcaagttcctgaaagctataaaagtttctcatgacttgagtggttttttccctgcccaccagaggagaaagcccttgtagaattctgcagtgttacaagtgttccctacaaaaactgaaaccatcagctcctctttaacaagttggctttttaaaagcacgtaattacaatttaatggtattctgtaaagtggtgctctaggcataatttaaattctttttaatgactatatttcttcaaaactttgaaagaaaaatgtgttctttttgctgcatcctttgtaagaagactgccaacagaggaaaaaggactttacaaattaagaccatcttggtttcatttccacaaagatgagaacaaatcatggtgttaggaaaggatccttagaagaacacaagaatttgaaagcccttggtggttatcactactatatttcatatttccacagaagtgacttagccaagctctgcattttgagcctgctgactttcatttaaaaggaatgaaaggctgaaaatccaggctgctgtgtctgtagataaaggtcaaaccatgtttgagttcttcactgttgtgtccacctaaataaaactgagtaagtaatgaaaaaaagtcttaata

SEQ ID NO: 736955 - DNA, 6783 bp, Homo sapiens
  misc_feature (1)..(2): n is a, c, g, or t
nnttttttctcataaattccttttaatcaattccttttctttccatcttactacatgcttttgtcacttcattaagtagatactatgtgccagtttttctgctaggtcctgataactgttaagatgaacaagacagggtttctagttccaaggagcacagaatctggtggagacagcagatatgccagtgaaggattatgacagaaggtgactgagcctcctgtaaatatgagcagcactctgttttctcctgacctcatattgcgttcccacagcagctccgaggctgttctcagtgtatgctgatcttcacttttattgagtgttttctctggaaaaaggccaataaaaacatttcatttctcttttggacaatatatatttctaagagccaggtttttctgcaccaaaaccttacaaccaatggtctgcactggttttccagccatgcttaagcccgtattaccaacatttctggtcccagtcgcctctgcaggggagtctcttccactagcgtgtttctgtttccagccctcaatggatacctcttcggaaacttcccggagcctgatatgtgtgttggagaatctgtgtcctggcacctatttggaatggggaatgaaatagacatccattctatctatttctatggtaacaccttcatcagcagagggcatcggactgatgtcgtcaacctgttcccagccaccttccttacaacagaaatgatagccgagaatcctgggaagtggatgataacctgccaggtcagcgaccactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcaggatataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagacgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcgtgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataagaaaaatgtaagcttatttcataaacatttaaagctgattcagaacatgttaaaaactgttcccaattccaactatgtaaatagatcctatgttcacattttacacacacacacaaaaatctttaacatctgtggaacttcccagttttagtcttagaaagttagcatgttgcataagttcagtaatcctcaggaacctccaagtttacttttagctcttacggacagttgtttacataatctaattactgttttctgaagaacggaaattatataagctgctgtctgccttttggaatattcagaaaagcagattttatttgtacttctgtgatgttttctgaaatggaaagctgatgataaatatcaaagtagcaatcagtgcgttaaattattctgttacatgatatttattactgttgaattattctgtgacttagaaatggcagtaacctaaataatggaatttgcaaaattattatattgccgtatctgagatgttccatcacaagtttctacactggtttcttttgaaaatttaaaaagatttacgagatacattttctaggatatgattttttttttacaaaaagcttcatcttctgtagactatccttaatttctattttgaaacggtaaaaattgatattttaggacaccaggaagtctccaagccattcccactctctgaactccagtagggtctgtgatgtcccaggcaccagtaccaagttggatgtgcagatatgcataggcaggtcccatccttgaggacttcagagtccagtaaaaggcagcagaaacatgggctggtgcctaagaggagaaagcgtagccacagtaaaggctatgccagaaaactcctagcaaatgctctgtgttcttgggagagggcacattgtttttgttttctctcctatagttcctgtaactgctggttttgagaatatagtaatcatttttcccagaggcagatgaccaccttaaggttctttagctgcaaatcctctaggttgaagtttgtgtgaaatagtcacagtgattttgaatagtaaggaatccagttgccttttgaaccttccctcacagggatgagagaacaagcctgtggaggttgtggagctactggtaaacaactgtcagggccccagaaggctgatgtggaggcctggggatacatttcatctaataaaagtattactaggtatcagtatcagtaataaaagtattataataaagtatcagtaataaaagtattataataaaaagtattattaggacaggtaaactcatccatctactgtgagctgctggcttggagaacgacttttgaggagccagtttcctgaggagaaatgcttttataaagcactcattgctttgtaaaaggagacaaaactgatcctaaatgaccactccagggttgctgattttgtttctggctcatgtctgcctagtaaaccaccagcaagctgctgaaccaggctggaaacaacattgttgcaactgggagggacatagagtactgtgaaagcagcgttccaacacatcttcacttttacaaagggataggcagagacttccaacatagaggttcttaaacttcgaggggttacaatccccttgcaaatatttttatagctatggaccctctcctcagatctacagccaacattttcagtgcaccttaggaggtcattttagtccacgcctctgaaaaagctgcactccaacggctgaagagcaagccatacggccgagaatggggctccctttgccttcatgaaagctacttcccccaacactaagactcagctgtacgtttgcttagctcagtcacatttacattcttctgggtgaactgtaccttttgagtacctgccttcattttctagaatcagacctaacaaggtcagtagaagcctgggcagcagcgggcctggaaagacgaggcagccagcatgaactgctgttctctccctgaccacaaggcgtcgtcttcctccagggtcaagtaattgttcttgttccgcctcacaggaatgtggggaggaaggacgttaacactataaaatgctgcgtcctaccttaaacttgtactgtgagaaagctggaaacttccacctgtacagtgggtctggtttgcatgtttagtttcatttgtgggaactgcttgtccaagagtgagctcaggtcagggcagtttgtgcctatgagaattagctcagctatcaggcaggtttttagacacctttttaaaatgtgctcgtgtttggtttgttttgcttactgtcagtcctgggtcaatcaaaggtttgtaagggtgagaatttttatgcactgctatatcgcaagtgcttaaaacagagactggcccagatgaggcattcttcaaatgtttgttgaaatgaatggacaaactcttaggataaatcctaatttgttggcaactgttatttgattttagaaggcaaactgattttattttagagaggggaaggggaggggaggctcattagcctcttggtagaaagaggactatttctgcaaatgaataggtttccaccttaagtagtgacagtccttaacttcttattatggagtgagtcttgaccgctttccaagttcaatagaagttcaagattgcctctcagtgattagggaaattgaagcttttaaagctcctggtctcagtaattcctcagaataaacctctttaaaagggatattgatggaaatgtacaattaccagtaattgaggttttatctgaggggatggagatgatgaaatggttccttcttggaagttgttggcattttggctttatttttcacaaataaagtgaaaccatttaaaacgattgacaacgattatatagtgccatgtggaatacaatagatattaatttgtggttggtttttctgcctgctttaaatgaaatgtattatgtttctgggttccttttttagctgtaaaaatacttcgtcactaaagcatgaaatttaatcagcagttgttcttcaagttcctgaaagctataaaagtttctcatgacttgagtggttttttccctgcccaccagaggagaaagcccttgtagaattctgcagtgttacaagtgttccctacaaaaactgaaaccatcagctcctctttaacaagttggctttttaaaagcacgtaattacaatttaatggtattctgtaaagtggtgctctaggcataatttaaattctttttaatgactatatttcttcaaaactttgaaagaaaaatgtgttctttttgctgcatcctttgtaagaagactgccaacagaggaaaaaggactttacaaattaagaccatcttggtttcatttccacaaagatgagaacaaatcatggtgttaggaaaggatccttagaagaacacaagaatttgaaagcccttggtggttatcactactatatttcatatttccacagaagtgacttagccaagctctgcattttgagcctgctgactttcatttaaaaggaatgaaaggctgaaaatccaggctgctgtgtctgtagataaaggtcaaaccatgtttgagttcttcactgttgtgtccacctaaataaaactgagtaagtaatgaaaaaaagtcttaata

SEQ ID NO: 736956 - DNA, 6648 bp, Homo sapiens
  misc_feature (1)..(2): n is a, c, g, or t
nnttttttctcataaattccttttaatcaattccttttctttccatcttactacatgcttttgtcacttcattaagtagatactatgtgccagtttttctgctaggtcctgataactgttaagatgaacaagacagggtttctagttccaaggagcacagaatctggtggagacagcagatatgccagtgaaggattatgacagaaggtgactgagcctcctgtaaatatgagcagcactctgttttctcctgacctcatattgcgttcccacagcagctccgaggctgttctcagtgtatgctgatcttcacttttattgagtgttttctcaacatttctggtcccagtcgcctctgcaggggagtctcttccactagcgtgtttctgtttccagccctcaatggatacctcttcggaaacttcccggagcctgatatgtgtgttggagaatctgtgtcctggcacctatttggaatggggaatgaaatagacatccattctatctatttctatggtaacaccttcatcagcagagggcatcggactgatgtcgtcaacctgttcccagccaccttccttacaacagaaatgatagccgagaatcctgggaagtggatgataacctgccaggtcagcgaccactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcaggatataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagacgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcgtgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataagaaaaatgtaagcttatttcataaacatttaaagctgattcagaacatgttaaaaactgttcccaattccaactatgtaaatagatcctatgttcacattttacacacacacacaaaaatctttaacatctgtggaacttcccagttttagtcttagaaagttagcatgttgcataagttcagtaatcctcaggaacctccaagtttacttttagctcttacggacagttgtttacataatctaattactgttttctgaagaacggaaattatataagctgctgtctgccttttggaatattcagaaaagcagattttatttgtacttctgtgatgttttctgaaatggaaagctgatgataaatatcaaagtagcaatcagtgcgttaaattattctgttacatgatatttattactgttgaattattctgtgacttagaaatggcagtaacctaaataatggaatttgcaaaattattatattgccgtatctgagatgttccatcacaagtttctacactggtttcttttgaaaatttaaaaagatttacgagatacattttctaggatatgattttttttttacaaaaagcttcatcttctgtagactatccttaatttctattttgaaacggtaaaaattgatattttaggacaccaggaagtctccaagccattcccactctctgaactccagtagggtctgtgatgtcccaggcaccagtaccaagttggatgtgcagatatgcataggcaggtcccatccttgaggacttcagagtccagtaaaaggcagcagaaacatgggctggtgcctaagaggagaaagcgtagccacagtaaaggctatgccagaaaactcctagcaaatgctctgtgttcttgggagagggcacattgtttttgttttctctcctatagttcctgtaactgctggttttgagaatatagtaatcatttttcccagaggcagatgaccaccttaaggttctttagctgcaaatcctctaggttgaagtttgtgtgaaatagtcacagtgattttgaatagtaaggaatccagttgccttttgaaccttccctcacagggatgagagaacaagcctgtggaggttgtggagctactggtaaacaactgtcagggccccagaaggctgatgtggaggcctggggatacatttcatctaataaaagtattactaggtatcagtatcagtaataaaagtattataataaagtatcagtaataaaagtattataataaaaagtattattaggacaggtaaactcatccatctactgtgagctgctggcttggagaacgacttttgaggagccagtttcctgaggagaaatgcttttataaagcactcattgctttgtaaaaggagacaaaactgatcctaaatgaccactccagggttgctgattttgtttctggctcatgtctgcctagtaaaccaccagcaagctgctgaaccaggctggaaacaacattgttgcaactgggagggacatagagtactgtgaaagcagcgttccaacacatcttcacttttacaaagggataggcagagacttccaacatagaggttcttaaacttcgaggggttacaatccccttgcaaatatttttatagctatggaccctctcctcagatctacagccaacattttcagtgcaccttaggaggtcattttagtccacgcctctgaaaaagctgcactccaacggctgaagagcaagccatacggccgagaatggggctccctttgccttcatgaaagctacttcccccaacactaagactcagctgtacgtttgcttagctcagtcacatttacattcttctgggtgaactgtaccttttgagtacctgccttcattttctagaatcagacctaacaaggtcagtagaagcctgggcagcagcgggcctggaaagacgaggcagccagcatgaactgctgttctctccctgaccacaaggcgtcgtcttcctccagggtcaagtaattgttcttgttccgcctcacaggaatgtggggaggaaggacgttaacactataaaatgctgcgtcctaccttaaacttgtactgtgagaaagctggaaacttccacctgtacagtgggtctggtttgcatgtttagtttcatttgtgggaactgcttgtccaagagtgagctcaggtcagggcagtttgtgcctatgagaattagctcagctatcaggcaggtttttagacacctttttaaaatgtgctcgtgtttggtttgttttgcttactgtcagtcctgggtcaatcaaaggtttgtaagggtgagaatttttatgcactgctatatcgcaagtgcttaaaacagagactggcccagatgaggcattcttcaaatgtttgttgaaatgaatggacaaactcttaggataaatcctaatttgttggcaactgttatttgattttagaaggcaaactgattttattttagagaggggaaggggaggggaggctcattagcctcttggtagaaagaggactatttctgcaaatgaataggtttccaccttaagtagtgacagtccttaacttcttattatggagtgagtcttgaccgctttccaagttcaatagaagttcaagattgcctctcagtgattagggaaattgaagcttttaaagctcctggtctcagtaattcctcagaataaacctctttaaaagggatattgatggaaatgtacaattaccagtaattgaggttttatctgaggggatggagatgatgaaatggttccttcttggaagttgttggcattttggctttatttttcacaaataaagtgaaaccatttaaaacgattgacaacgattatatagtgccatgtggaatacaatagatattaatttgtggttggtttttctgcctgctttaaatgaaatgtattatgtttctgggttccttttttagctgtaaaaatacttcgtcactaaagcatgaaatttaatcagcagttgttcttcaagttcctgaaagctataaaagtttctcatgacttgagtggttttttccctgcccaccagaggagaaagcccttgtagaattctgcagtgttacaagtgttccctacaaaaactgaaaccatcagctcctctttaacaagttggctttttaaaagcacgtaattacaatttaatggtattctgtaaagtggtgctctaggcataatttaaattctttttaatgactatatttcttcaaaactttgaaagaaaaatgtgttctttttgctgcatcctttgtaagaagactgccaacagaggaaaaaggactttacaaattaagaccatcttggtttcatttccacaaagatgagaacaaatcatggtgttaggaaaggatccttagaagaacacaagaatttgaaagcccttggtggttatcactactatatttcatatttccacagaagtgacttagccaagctctgcattttgagcctgctgactttcatttaaaaggaatgaaaggctgaaaatccaggctgctgtgtctgtagataaaggtcaaaccatgtttgagttcttcactgttgtgtccacctaaataaaactgagtaagtaatgaaaaaaagtcttaata

SEQ ID NO: 736957 - DNA, 6357 bp, Homo sapiens
gggcggcgcggaggggcagggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcaactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtgtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcaggatataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagacgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcgtgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataagaaaaatgtaagcttatttcataaacatttaaagctgattcagaacatgttaaaaactgttcccaattccaactatgtaaatagatcctatgttcacattttacacacacacacaaaaatctttaacatctgtggaacttcccagttttagtcttagaaagttagcatgttgcataagttcagtaatcctcaggaacctccaagtttacttttagctcttacggacagttgtttacataatctaattactgttttctgaagaacggaaattatataagctgctgtctgccttttggaatattcagaaaagcagattttatttgtacttctgtgatgttttctgaaatggaaagctgatgataaatatcaaagtagcaatcagtgcgttaaattattctgttacatgatatttattactgttgaattattctgtgacttagaaatggcagtaacctaaataatggaatttgcaaaattattatattgccgtatctgagatgttccatcacaagtttctacactggtttcttttgaaaatttaaaaagatttacgagatacattttctaggatatgattttttttttacaaaaagcttcatcttctgtagactatccttaatttctattttgaaacggtaaaaattgatattttaggacaccaggaagtctccaagccattcccactctctgaactccagtagggtctgtgatgtcccaggcaccagtaccaagttggatgtgcagatatgcataggcaggtcccatccttgaggacttcagagtccagtaaaaggcagcagaaacatgggctggtgcctaagaggagaaagcgtagccacagtaaaggctatgccagaaaactcctagcaaatgctctgtgttcttgggagagggcacattgtttttgttttctctcctatagttcctgtaactgctggttttgagaatatagtaatcatttttcccagaggcagatgaccaccttaaggttctttagctgcaaatcctctaggttgaagtttgtgtgaaatagtcacagtgattttgaatagtaaggaatccagttgccttttgaaccttccctcacagggatgagagaacaagcctgtggaggttgtggagctactggtaaacaactgtcagggccccagaaggctgatgtggaggcctggggatacatttcatctaataaaagtattactaggtatcagtatcagtaataaaagtattataataaagtatcagtaataaaagtattataataaaaagtattattaggacaggtaaactcatccatctactgtgagctgctggcttggagaacgacttttgaggagccagtttcctgaggagaaatgcttttataaagcactcattgctttgtaaaaggagacaaaactgatcctaaatgaccactccagggttgctgattttgtttctggctcatgtctgcctagtaaaccaccagcaagctgctgaaccaggctggaaacaacattgttgcaactgggagggacatagagtactgtgaaagcagcgttccaacacatcttcacttttacaaagggataggcagagacttccaacatagaggttcttaaacttcgaggggttacaatccccttgcaaatatttttatagctatggaccctctcctcagatctacagccaacattttcagtgcaccttaggaggtcattttagtccacgcctctgaaaaagctgcactccaacggctgaagagcaagccatacggccgagaatggggctccctttgccttcatgaaagctacttcccccaacactaagactcagctgtacgtttgcttagctcagtcacatttacattcttctgggtgaactgtaccttttgagtacctgccttcattttctagaatcagacctaacaaggtcagtagaagcctgggcagcagcgggcctggaaagacgaggcagccagcatgaactgctgttctctccctgaccacaaggcgtcgtcttcctccagggtcaagtaattgttcttgttccgcctcacaggaatgtggggaggaaggacgttaacactataaaatgctgcgtcctaccttaaacttgtactgtgagaaagctggaaacttccacctgtacagtgggtctggtttgcatgtttagtttcatttgtgggaactgcttgtccaagagtgagctcaggtcagggcagtttgtgcctatgagaattagctcagctatcaggcaggtttttagacacctttttaaaatgtgctcgtgtttggtttgttttgcttactgtcagtcctgggtcaatcaaaggtttgtaagggtgagaatttttatgcactgctatatcgcaagtgcttaaaacagagactggcccagatgaggcattcttcaaatgtttgttgaaatgaatggacaaactcttaggataaatcctaatttgttggcaactgttatttgattttagaaggcaaactgattttattttagagaggggaaggggaggggaggctcattagcctcttggtagaaagaggactatttctgcaaatgaataggtttccaccttaagtagtgacagtccttaacttcttattatggagtgagtcttgaccgctttccaagttcaatagaagttcaagattgcctctcagtgattagggaaattgaagcttttaaagctcctggtctcagtaattcctcagaataaacctctttaaaagggatattgatggaaatgtacaattaccagtaattgaggttttatctgaggggatggagatgatgaaatggttccttcttggaagttgttggcattttggctttatttttcacaaataaagtgaaaccatttaaaacgattgacaacgattatatagtgccatgtggaatacaatagatattaatttgtggttggtttttctgcctgctttaaatgaaatgtattatgtttctgggttccttttttagctgtaaaaatacttcgtcactaaagcatgaaatttaatcagcagttgttcttcaagttcctgaaagctataaaagtttctcatgacttgagtggttttttccctgcccaccagaggagaaagcccttgtagaattctgcagtgttacaagtgttccctacaaaaactgaaaccatcagctcctctttaacaagttggctttttaaaagcacgtaattacaatttaatggtattctgtaaagtggtgctctaggcataatttaaattctttttaatgactatatttcttcaaaactttgaaagaaaaatgtgttctttttgctgcatcctttgtaagaagactgccaacagaggaaaaaggactttacaaattaagaccatcttggtttcatttccacaaagatgagaacaaatcatggtgttaggaaaggatccttagaagaacacaagaatttgaaagcccttggtggttatcactactatatttcatatttccacagaagtgacttagccaagctctgcattttgagcctgctgactttcatttaaaaggaatgaaaggctgaaaatccaggctgctgtgtctgtagataaaggtcaaaccatgtttgagttcttcactgttgtgtccacctaaataaaactgagtaagtaatgaaaaaaagtcttaata

SEQ ID NO: 736958 - DNA, 5703 bp, Homo sapiens; identical to SEQ ID NO: 37240

SEQ ID NO: 736959 - DNA, 751 bp, Homo sapiens
gagctgccaggcgggagcggcgtaggcgcggggtcgccggccagcgtgaaccgggacatggagccgcccggcgggagcctggggcccggccgcgagacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctgtgagtcctgggacaggtacccatgacatgggagactgtgcccttgtcttggacctgttttttttttgccaattttatgtaacattttatgtctgcatcaattctgtttcattccattatataagcctgttcactttttactgtcttatttagttaccgttcttacatacattttgcctggttaaattttcatgaagtatgtaaatatagggaatgggataggcagttctaagtctcatttatgttggtggtatgtgagatgggtatctgccctgataaacgtggcctgacatggtggcttactcctgtaatctgagca

SEQ ID NO: 736960 - DNA, 233 bp, Homo sapiens; identical to SEQ ID NO: 37241
  misc_feature (211)..(211): n is a, c, g, or t

SEQ ID NO: 736961 - DNA, 556 bp, Homo sapiens
gtatgtgactggaataatttttcttctccattttcaattttatcattttctcttagttcagaggacaattgagttggttgggtgtcctctcggtcataaatactaggtaagattgtgtttcttcccagaagtgaacactaagcatcttaaaatttaagaacaattcctaagtgatgggtgctatcctgaatgttccactggtcatcagaggtatagcaaaatgtctcctatatctccattaatatctgtattgtctaggatgagggtttctttttactattcttttttctaaacttctcttctcacttcatttcattaatttgatcttcaatcactgataccctttcttccactagatcgaatcggctactgaagcatgtgtatgtgtcatgtagttctcgcgccatggttttcagctccatcaggtcatttaaggtcttctctacactgtttattctagttaccatttgtctaatctcttttcaagtttttagcttcctgcgatgggttcgacatcctcctttagcttggagatagtcatgttagtacccacttc

SEQ ID NO: 736962 - DNA, 423 bp, Homo sapiens; identical to SEQ ID NO: 37259

SEQ ID NO: 736963 - DNA, 1429 bp, Homo sapiens; identical to SEQ ID NO: 37256

SEQ ID NO: 736964 - DNA, 5679 bp, Homo sapiens; identical to SEQ ID NO: 37243

SEQ ID NO: 736965 - DNA, 5732 bp, Homo sapiens
gagctgccaggcgggagcggcgtaggcgcggggtcgccggccagcgtgaaccgggacatggagccgcccggcgggagcctggggcccggccgcgagacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagacaacctcttgtgcccctgggaagtagaggaggaggaggagacctttaaattgccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 736966 - DNA, 3100 bp, Homo sapiens; identical to SEQ ID NO: 37254
  misc_feature (3058)..(3058): n is a, c, g, or t
  misc_feature (3084)..(3084): n is a, c, g, or t

SEQ ID NO: 736967 - DNA, 2392 bp, Homo sapiens
gagctgccaggcgggagcggcgtaggcgcggggtcgccggccagcgtgaaccgggacatggagccgcccggcgggagcctggggcccggccgcgagacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 736968 - DNA, 2166 bp, Homo sapiens; identical to SEQ ID NO: 37250

SEQ ID NO: 736969 - DNA, 3224 bp, Homo sapiens; identical to SEQ ID NO: 37247

SEQ ID NO: 736970 - DNA, 1405 bp, Homo sapiens; identical to SEQ ID NO: 37253

SEQ ID NO: 736971 - DNA, 2411 bp, Homo sapiens; identical to SEQ ID NO: 37249

SEQ ID NO: 736972 - DNA, 2068 bp, Homo sapiens; identical to SEQ ID NO: 37251

SEQ ID NO: 736973 - DNA, 3222 bp, Homo sapiens; identical to SEQ ID NO: 37248

SEQ ID NO: 736974 - DNA, 3598 bp, Homo sapiens
ggtcggaatctgggaatcgtcgaccccgcgtcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 736975 - DNA, 1973 bp, Homo sapiens; identical to SEQ ID NO: 37252

SEQ ID NO: 736976 - DNA, 3464 bp, Homo sapiens
  misc_feature (18)..(18): n is a, c, g, or t
gggcttccgggaaatggnggaggtggagggattccaggacctccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 736977 - DNA, 5389 bp, Homo sapiens
actgcgctctgctatatctacatcagctaccctaccctatctacgtcaaataatcaaaacttcttgtgatccgcccgcctcggcctcccaaagtgctaggattacaagcgtgagccactgcgcccagccaacttacagatattttttaaagcagatttcactatctgttctaggtgatcatttttacaaatgatactgcagtgaacatccttgtgcatatcttctttcacatttatgcccatatgttggatacatttctagaagtagactatatgttacatgcatgagaaattgattagtactgttaaatgcccctccaaaagttgtatcaatttatacttcattgaataggggacttgatttggtatttatggacaggagcctagggatggattgtagggaatgcatttccctgaagagatggtccttagctttcagcagtttctggaaactgagtggtgagaataataatgtgagaaatccggaacactgataatgtcctgtttcctaatcggtctgtgcccctgtgtaatttactcattatacgtgtccgtgtcacagtacctggaaagttctctccgtttcctttctcttgggcaggaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 736978 - DNA, 2711 bp, Homo sapiens
ccgatgcgagtatacattcgaatgactgactgttggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgctagcccgtg

SEQ ID NO: 736979 - DNA, 1058 bp, Homo sapiens
ttaacagaagcactctgcctggaggtgcgaccaacatattttgagatgaagaacgaaaaactgctgtccaaagcatcagaaccaaaataccagctttttgttccccagcttgtgactggcagatgcgctacaagagcttttcatagaaaatcacatagtttggatctgaacatcagtgagaaactgactttattacccactttatatgaaatacatagtaagactactgcctattccagactaaatgaaacacagcctattgacctttcaggcttgcctttacaatctagtaaaaatagctattcctttcagaatccatccagttttgatcctagtatgctgctgcaaagattttcagtggccccccatgagacccagacacaaagaggaggagaatttcagtgtggtctagaagctgcttcagtgtattctgaccatactaatactaacaatctgactttcctgatggacctgccctcagctggcaggagcatgccggaggcctcagaccaggaagagcacctctcccctctggacttcctgcactcagccaatttttcattgggcagcattaatcagaggcttaataagagagaaaggagcaagttgaagaatctaagaaggaaacaacgaaggcgtgaaagatggctacagaagcagggtaaatactcaggagtgggattgctggatcatatgactttgaataatgagatgagtacagatgaagacaattctatagacatcaaacgcatgaagcatttcggatctgctttaagactgaggcagactttccatctggacacagccgaccatccatgtgtcattacaatgaatccagcacttccctggaagctggaagggtcaaattcaacttcaactctgccacttcctgcttaacttgctgtttaaccttgggcaagctgccatcccacacgaggccgaaggtgtcggtttttaaaatacagaaattgggttccatgagggattatcaatatactgctggtgggccaaattccatctgctacttgcctttgtaaataaagttttattgaaacaca

SEQ ID NO: 736980 - DNA, 1767 bp, Homo sapiens
ttaacagaagcactctgcctggaggtgcgaccaacatattttgagatgaagaacgaaaaactgctgtccaaagcatcagaaccaaaataccagctttttgttccccagcttgtgactggcagatgcgctacaagagcttttcatagaaaatcacatagtttggatctgaacatcagtgagaaactgactttattacccactttatatgaaatacatagtaagactactgcctattccagactaaatgaaacacagcctattgacctttcaggcttgcctttacaatctagtaaaaatagctattcctttcagaatccatccagttttgatcctagtatgctgctgcaaagattttcagtggccccccatgagacccagacacaaagaggaggagaatttcagtgtggtctagaagctgcttcagtgtattctgaccatactaatactaacaatctgactttcctgatggacctgccctcagctggcaggagcatgccggaggcctcagaccaggaagagcacctctcccctctggacttcctgcactcagccaatttttcattgggcagcattaatcagaggcttaataagagagaaaggagcaagttgaagaatctaagaaggaaacaacgaaggcgtgaaagatggctacagaagcagggtaaatactcaggagtgggattgctggatcatatgactttgaataatgagatgagtacagatgaagacaatgaatatgcagaagaaaaggatagctacatctgtgcagtgtgtctggacgtttatttcaacccttatatgtgttacccttgccatcacatcttctgtgagccctgcttacggactctggccaaagacaatccttcaagcactccatgcccattgtgtcggacaattatttctagagtctttttccaaacagaattgaacaatgccacaaaaactttctttactaaagaatatttgaaaataaaacaaagctttcagaaatccaactctgcaaaatggcccctaccaagctgcagaaaagcatttcatctttttggaggtttccgcagacatgcagctccagttacaagaaggcagttcccacacggtgcacacaggatggattacctgcactttgaggatgatagccgtggatggtggtttgacatggatatggtgatcatatatatttattcagtgaactgggtcattggattcattgttttctgctttctttgctattttttctttccgttttaggaatttcataccttactacaattgaccaatcataaatgatgtaaataacaattgcttaaacatttttaaatgtgctttgaagtttttttaatgttgcattatacaaattgttgatgtttatagaaagcctgagaataatgaatttatttattaatgtttttcatgtaacaaactaaactttattcaagagctaacctacccagcacttagcaacaatgcactattaatttcatagttgttcttgggttaggatttggggctctgattttataatatcactttaatacttattttgattgtaaaaaactgaagttttctctccacttaaaaatagtaaaaatacaaaaagaaatgataatctaggtagatattatctttactgataaaatatttagtcaatcaccacttattctcaggcaaattatatgtattaaagataaaccatattctctgggaactaatctagcagggtatattcagttttggtttctaattgtcactacttatatccctttctag

SEQ ID NO: 736981 - DNA, 871 bp, Homo sapiens
  misc_feature (763)..(763): n is a, c, g, or t
ccgtgatagccgtcagagcctgactctagagtatacctctctcaagctggaaaaagaaggataagcaaacaggtattaccagagaggtaagagaaaaccaggagagtgtggaatgtcatgaaagccaagggaagagaacatttcaagactgacagatactaataataaatgctaacatctgttaagtcccagtcatggccagacattctgctcaggactttgaatacatgattgaatttaatgttaacaactttttgaggtgggagccatttcccttttcatagacaaggaaactgtggcaaagaatggttaagcagctgactcatggtcaggtggctggtaagtgaagctggcatttaagctcaagcagcctgactccgaactttatccacttttctctaatacaacccttagtgcagtttgggaggtcatataagatgaagcctgaagagtggtcggtagacagactgatgaagctgttattcggaatattactaaaggaatgttgtttcaggggagaaacagaatgaaagccaggctggagcccatggttaggaatgctccatgacattctcttttttcagcttgagtgagggaacctcaagagaccaggccaggtgccgtggctcatacctgtaatcccaacactttgtgaggcccaggtgggaggatctcgagcccaggagtttgagaccagcctgggcaacagagcaagaccctgtctctacaaaaaattaaaaaaaaattagctgggcatggtagngtgtgcctgtagtcccagctactcaggaggattgtttaagcctgggagattgaggctatagtaagctatcatcatgccactgcactccagcctgggcaatagagcaag

SEQ ID NO: 736982 - DNA, 733 bp, Homo sapiens
  misc_feature (625)..(625): n is a, c, g, or t
cagtggcttacttccgtaatcccaagcactttgggaggctggggcaggaggatcgctggagttcaagaccagcctgggcaacatagtattaataagaccttgtttctacttaaaataaaaaaaaatggcaaggtgtggtggcatagacaaggaaactgtggcaaagaatggttaagcagctgactcatggtcaggtggctggtaagtgaagctggcatttaagctcaagcagcctgactccgaactttatccacttttctctaatacaacccttagtgcagtttgggaggtcatataagatgaagcctgaagagtggtcggtagacagactgatgaagctgttattcggaatattactaaaggaatgttgtttcaggggagaaacagaatgaaagccaggctggagcccatggttaggaatgctccatgacattctcttttttcagcttgagtgagggaacctcaagagaccaggccaggtgccgtggctcatacctgtaatcccaacactttgtgaggcccaggtgggaggatctcgagcccaggagtttgagaccagcctgggcaacagagcaagaccctgtctctacaaaaaattaaaaaaaaattagctgggcatggtagngtgtgcctgtagtcccagctactcaggaggattgtttaagcctgggagattgaggctatagtaagctatcatcatgccactgcactccagcctgggcaatagagcaag

SEQ ID NO: 736983 - DNA, 601 bp, Homo sapiens
ccctctcccacaacctgtcaaaccagagatgccagtttccccaggactcccaggagctcccgcccctagctggtaccagggagagcctttgcaggctcggtgggcagtgcccccaacccatgccccatgcacctgcttatcgatcactgcctgtctggatgtgtctcgtgtcagagccctctggtgtgaacttgccgagtactgagaggccaagacgtgagacaattacaagcaggggagagaagtggtaccctgtgacaagaggcagctgtggagaaaggggcaggctccatgcccggggtgagcgccatctgggcaggaggcctggcttccagctgtgggggcttgggaagggcagagcctgggaggaatgattttgaagccactactatggagattaaggggatgagaatgtaaatctcaagtaaaaaggtaattgaatgtaatagcaaacactgctcgctctatgttaattttagctcttcccctggatacaagacgctgtattagtgttttattaccattttgtttgcactaataaaatagtaaaatttatttcaaggaagttgaaggatggttttacaatgcaaatttgaagaaa

SEQ ID NO: 736984 - DNA, 905 bp, Homo sapiens
  misc_feature (800)..(800): n is a, c, g, or t
  misc_feature (861)..(861): n is a, c, g, or t
cagattcgctgctcacgtttcttttttccgtggcccttcctgccctttgtttctctcttcatgtcacccgcgggacaactctacgtgcaagtcgctgaaatcgattttctgcttcttatagtaagcggcgggctcgccagcctcgagcgaaagtgtgactgcgaacgggcaggcgcgcgcggggctcggcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatgggaactgccccaaagggggcccggggcccggggccttggggccctacaggccggcccgccagaagctcgactgggagggcaaacccccaggccccttcgcggggtgggggggattcccaagaccccggggccccgccctccctggttgggcccctgagagggggaaagcgcttccctccaaccctgggggcgccctgggcagagggccccctagggccggtgggtcctcgggcgncggcgacctcggctccctcccctcgcggggccggcgcgccgcctcctcgctccttgtgcgncgcgcgcgccgcggcgggcgcgcaacacacaacaaaaaaaaaaa

SEQ ID NO: 736985 - DNA, 797 bp, Homo sapiens
cagattcgctgctcacgtttcttttttccgtggcccttcctgccctttgtttctctcttcatgtcacccgcgggacaactctacgtgcaagtcgctgaaatcgattttctgcttcttatagtaagcggcgggctcgccagcctcgagcgaaagtgtgactgcgaacgggcaggcgcgcgcggggctcggcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatggctggagtgcaatggcgcgatctcaggtcatcacaacttccgcctcccaggttcaagcgattctcctgccacagcctcccgagtagctgggattacaggcatgcaccaccacacccggctaattttgtatgttttgtagagacaggatttctccatgttggtcaggctggtctgtaactcccgacctcaggtgatccacgcgccttggcctcccaaagtctgggatgacagg

SEQ ID NO: 736986 - DNA, 312 bp, Homo sapiens; identical to SEQ ID NO: 16387

SEQ ID NO: 736987 - DNA, 6746 bp, Homo sapiens
  misc_feature (4811)..(4811): n is a, c, g, or t
  misc_feature (6113)..(6113): n is a, c, g, or t
cagattcgctgctcacgtttcttttttccgtggcccttcctgccctttgtttctctcttcatgtcacccgcgggacaactctacgtgcaagtcgctgaaatcgattttctgcttcttatagtaagcggcgggctcgccagcctcgagcgaaagtgtgactgcgaacgggcaggcgcgcgcggggctcggcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatggtgagaagcttgactacaagacctgtgaggccctggaagaggtcttcaagaggctgcagttcaaggtcgtggacctggagcagacaaacctggatgaagatgtgagcggccctgccaccgcccacttggctccctgagctcccgggccccttcgagggtgcctcggccctcttcgacatgatcgagtactacgagtcggccacccacctcaacatctccttcaacaagcacatcggcacccggggctggcaggcggccgcccacatgatgcgcaagacgagctgcctgcagtatctggacgcccgcaacacgcccctgctggaccactcggcgcccttcgtggcccgtgccctgcgcatccgcagcagcctggcagtgctgcacttggagaacgccagcctgtcggggcggcccctcatgctgctcggtgagccccaagcccgggagggtgagcaggatgtgcagcctgttggggggcaggggcctgcccagtcaccgtgccccctccccgtccccagccacggccctgaagatgaacatgaacctgcgggagctgtacctggcggacaacaagctcaacggcctgcaggactcggcccagctgggtaacctgctcaagttcaactgctccctgcagatcctggacctccggaacaaccacgtgctagactcgggtgggtgcagtggcccaccccacccacacccgtcacccagcacccactctgcccggccctgcgctaggtggtgctggggacacagacatggccaagaccaccccaacgctgtcctgctggggctcccaggaggaagacagacccgccctagacagtgacaacctagagtgggcaggactgggctggtggagcccagaggcggggtccgatcagtctgggggccagggagggcttccaggaggaggagacagctcagctgacagccgcaggatgaggcgaagtgaataattacaatctgaaaagaaagcagtgttgctgccataacagggtcagctagaggctgctttcagatgggagaggagggaagaccaccgtggggcggggcctctgggcttccatccggaggctgggagcagaaccagccttgtgagaagcctgggaaagggtccagaccgcgggagcagtgagtgcagtgggaggagctctggtgtttgatgctgggggttgagcagagaatggggagccgtcaaaggaggcgttcctgttgcatcctggaggggtggggtgggtcactgtgtccccaggtggcaggcccagaccccactctactgagcacctgccaagggccatggctgtcggcccctgggctcagctcggagggagacacagggctctgcccttgggagtttgtactccagtctagagagacaacgataagatgagtgaaatctccagcctgtcagatggtgggatctgcattggagggagacagtggtgactgtgggtgggagtgagctggctgtgaggtgaggtgggccagaggtggtcacatttgagcaaagatcagaagcatctggtggaggctgtcatccaggcacccaggcccaggggtcacagatgtgtgcccaggggtgccaggccgaggcagggctgcagggcaaggcctgggactgcggggcctccatggaggtcctaagcagagggggttgctcctaccctgcagtcccctccccaggaagcacccggaccccagacagggctctgactgccggcctcctccaggtctggcctacatctgcgagggcctcaaggagcagaggaaggggctggtgaccctggtgctgtggaacaaccagctcacgcacacaggcatggccttcctgggcatgacactggtgagtcaggctggcagggaagggaggcacctcggtccccgctgccacctcccactccagctctcagcacagttgcctctagctgacggctcctgtcctgcccatcctgcaggttcaagacgatttaaactcagccccacctgcttcctcattcagcttctgtgcctgttttccctgaggaggagcccttctttcattatctcctttttttttttgagaccgagtctcatcctgtcacccaggctggagtgcagtggcgccatctaggctcactgcagccactccagcccccgcctcctgggttcaagccattcttctgcctcagcctcccaagtagctgggactacaggtgcccgccaccccgcctagccaatttttttattttttatttttattttttttgagacggagcctcaatcgcccaggctggagtgcagtggctcgatctccgctcactgcaagccccacctcctgggttcacaccattgtcctgcctcagcctcccgagtagttggaactacaggcacccaccaccacacccagctaatttttttgtatttttttagtagagaggggatttcaccatgttagccaggatggtcgcaatctgaccttgtgatccaccctcctcggcctcccaaagtgctgggattacacgcgtgagccaccgcgcccggcctaatttttgtatttttagtacagacggggtttcaccatgttggccaggccggtcttgaactcctgacctcgagtgatcccccccacctcggcctccgaaagtattgggattatgagtgagtcaccgtgcctggttttcagtttttatgtggtgcttaaagcaagccactcaggtacagagactctcagggcgagcactcgtgtgctcaaaccccgggataagagttgccctccttgggggcttcagggcgctcaaggtccaggccctggccaggggcccaggctgtggggggtagggactgactgggtgcctggggagctgggagtggacgggggacctggcatttggggagacttcaggcacaggagggacttcaggccaggcctgcggcagggcaggacggcgccggtgttcacgcaggcgcgcgaaagaaaaggagcgcccgggcctggctctcttcccggcttctttcctgacttggcctcctgggtctcctccgccatcacggcctcctcctcaccctcacaccccctccctccagccgcacactcagagcctggagacgctgaacctgggccacaaccccatcgggaacgagggtgtgcggcacctcaagaacgggctcatcagcaaccgcagcgtgctgcgcctcgggctggcctccaccaagctcacgtgcgagggcgcggtggcggtggcggagttcatcgctgagagcccccgcctcctgagactggaccttcgggagaacgagatcaagacaggcgggctcatggcactgtcgttggccctcaaggtgaaccactcactgctgcgcctggacctcgaccgtgaacccaagaaagaggcggtgagcaggggacggtcctgcagccctggggcgggcggaaggccgggtggtggggccggcctgagagccctagccaggcgctcccgccacaggtgaagagcttcatcgagacgcagaaggcgctgctggccgagatccagaacggctgcaagcgcaacttggtgctggcgcgggagagggaggagaaggagcagccgccacagctgtcggcctccatgcctgagaccaccgccaccgagccccagcccgacgacgagcccgccgctggggtgcagaacggggcccccagccccgcacccagcccggactcagactcagactcggactcggatggggaggaagaggaggaagaggaaggggagagggacgagaccccctgtcctgccctggtgccccccacggactccctgggccctggggacaggagtcccccaggcagcccctccacacccaccgagcagcggatttccgtgtccagcccgggccggggccacaaggtgtttgtggtgacccgggtggagagcccgcccgagagggcagagccccctgcgtcccccacccctccctctcccccaccccctccctccccacccgcctcaccttccctaccaccagccggggccattgacacccgggacacagggtcctctgagcctcagccaccaccggagccgcctcggtcagggccaccactgcccaacggcctgaagcccgagttcgccctggcactgccccctgagccgcccccggggcctgaggtcaaggggggcagctgcggcctggagcacggtgagaggggccctagggcaggtgttgaggggccctgggtgctgtatgtgaccccaggcaagcccctgcctgttgtggncctcagtttccccctctttaaaatggttctcgcaggggccagcaaagtggggcttagttctcatctccaccctgcttcccttgggtcctgggagctcttcctggggtgggggggcatgtaaggtgtgctgccttgagcctgaccatctcagcggtctctgggcactctgcaggccctgagggtctggctggggccgggctggggacaggttgtatttgccccacccgcctgacgggggtgctggcccgtcctcccacacagaactgagctgctccaagaacgagaaggagctcgaggagctgcttctggaagccagtcaggaatccgggcaggagacactgtgacactttaggtgaggccaggcccggggcccacagcactcgggaggagctgagagagcctctggctctgacagtctctcccccaatctctcctccccaagttccctttttccggtcggtctgcgatgagctgaggccagagccatgagaatctgctcaccttccccccagccttcctgaggcccaggatgccaggggtgggggccattctggggcccccctccccccacagcaacactacaaggggtgcaggagctacagggagtggccctccgcgcgtgactcaagcacttctatttatgagcccagcactggaagactctgggggtgaatgggaggagggggagcaggaggaggaggaggtctccaaggacatcaggcgcctgttctggaggggccaggcttgccctgcggagggcaggcgtcctgggtggtggtgggatggtcccctgtggccccgggcacagggccgggcaggcagcctggtgccggagaggcggtgcgtgctggtggtggttgagatgcgcagaacagccccagacagcgcaggccgggcagggtggggggatgggagcagaggatcagagctttctttttctcaagtgcaataaatctatcagggagctggggcgggagcagccggcactccgggaccctgctgtccaggccactggaggctgcgccctgagaggcactacagccctttgggggcgagtggcatgggtgtgggtgagggtgggcagagggctggggctactcctgtcggtgcaactctgttcacaccttttctaataaactggggctgggttcactttgcccaacgtctgcttcgtgcggatcctggaggtggttgctgggggtgggctgggtggaggccatcacagctcctggttacagagcatctgccagggcactggtcaggcattactgcgtcttcccccacagtcccgtctattctgcntccatgctctggtgtctcgtacggtcacctcccagccaggcgagtttacacccatcctttctgcagggagagacaggccccagatacctcctggcttcaggtctagggtctcaggatgctggatatggagtggctctgcccagtcgcccatcgctcaacaggaacagatcccagcctgtccctggcagccccaggtgttgtgcaggtgggagtatgccccgggcccagccagcactgcaggagcctggtgggcggcttgttcccctttgccagcaggggcctggggggccatgggggtgctgttgcggatttctgagaggtctgtttttccctttaggaaaggggggagcaggccgggcatggtggcccacacctgtaatcccagcactttgggaggctgaggtgggaggattgcttgaacccaggaatttgacaccagcctgggcaacatggtgaaaccccatctccatagaaaatacaaaaattagctgggtgtggtggcgtgtgcctgtagtcccagctactgaggaggctgagttgggaggatcgcttgaacccaggaggttgaggctgcagtgaggtgtgattgcaccactgcacttcagcctgggcaacagagtgagatcctgtctc

SEQ ID NO: 736988 - DNA, 5967 bp, Homo sapiens
cagattcgctgctcacgtttcttttttccgtggcccttcctgccctttgtttctctcttcatgtcacccgcgggacaactctacgtgcaagtcgctgaaatcgattttctgcttcttatagtaagcggcgggctcgccagcctcgagcgaaagtgtgactgcgaacgggcaggcgcgcgcggggctcggcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatggtgagaagcttgactacaagacctgtgaggccctggaagaggtcttcaagaggctgcagttcaaggtcgtggacctggagcagacaaacctggatgaagatgtgagcggccctgccaccgcccacttggctccctgagctcccgggccccttcgagggtgcctcggccctcttcgacatgatcgagtactacgagtcggccacccacctcaacatctccttcaacaagcacatcggcacccggggctggcaggcggccgcccacatgatgcgcaagacgagctgcctgcagtatctggacgcccgcaacacgcccctgctggaccactcggcgcccttcgtggcccgtgccctgcgcatccgcagcagcctggcagtgctgcacttggagaacgccagcctgtcggggcggcccctcatgctgctcggtgagccccaagcccgggagggtgagcaggatgtgcagcctgttggggggcaggggcctgcccagtcaccgtgccccctccccgtccccagccacggccctgaagatgaacatgaacctgcgggagctgtacctggcggacaacaagctcaacggcctgcaggactcggcccagctgggtaacctgctcaagttcaactgctccctgcagatcctggacctccggaacaaccacgtgctagactcgggtgggtgcagtggcccaccccacccacacccgtcacccagcacccactctgcccggccctgcgctaggtggtgctggggacacagacatggccaagaccaccccaacgctgtcctgctggggctcccaggaggaagacagacccgccctagacagtgacaacctagagtgggcaggactgggctggtggagcccagaggcggggtccgatcagtctgggggccagggagggcttccaggaggaggagacagctcagctgacagccgcaggatgaggcgaagtgaataattacaatctgaaaagaaagcagtgttgctgccataacagggtcagctagaggctgctttcagatgggagaggagggaagaccaccgtggggcggggcctctgggcttccatccggaggctgggagcagaaccagccttgtgagaagcctgggaaagggtccagaccgcgggagcagtgagtgcagtgggaggagctctggtgtttgatgctgggggttgagcagagaatggggagccgtcaaaggaggcgttcctgttgcatcctggaggggtggggtgggtcactgtgtccccaggtggcaggcccagaccccactctactgagcacctgccaagggccatggctgtcggcccctgggctcagctcggagggagacacagggctctgcccttgggagtttgtactccagtctagagagacaacgataagatgagtgaaatctccagcctgtcagatggtgggatctgcattggagggagacagtggtgactgtgggtgggagtgagctggctgtgaggtgaggtgggccagaggtggtcacatttgagcaaagatcagaagcatctggtggaggctgtcatccaggcacccaggcccaggggtcacagatgtgtgcccaggggtgccaggccgaggcagggctgcagggcaaggcctgggactgcggggcctccatggaggtcctaagcagagggggttgctcctaccctgcagtcccctccccaggaagcacccggaccccagacagggctctgactgccggcctcctccaggtctggcctacatctgcgagggcctcaaggagcagaggaaggggctggtgaccctggtgctgtggaacaaccagctcacgcacacaggcatggccttcctgggcatgacactggtgagtcaggctggcagggaagggaggcacctcggtccccgctgccacctcccactccagctctcagcacagttgcctctagctgacggctcctgtcctgcccatcctgcaggttcaagacgatttaaactcagccccacctgcttcctcattcagcttctgtgcctgttttccctgaggaggagcccttctttcattatctcctttttttttttgagaccgagtctcatcctgtcacccaggctggagtgcagtggcgccatctaggctcactgcagccactccagcccccgcctcctgggttcaagccattcttctgcctcagcctcccaagtagctgggactacaggtgcccgccaccccgcctagccaatttttttattttttatttttattttttttgagacggagcctcaatcgcccaggctggagtgcagtggctcgatctccgctcactgcaagccccacctcctgggttcacaccattgtcctgcctcagcctcccgagtagttggaactacaggcacccaccaccacacccagctaatttttttgtatttttttagtagagaggggatttcaccatgttagccaggatggtcgcaatctgaccttgtgatccaccctcctcggcctcccaaagtgctgggattacacgcgtgagccaccgcgcccggcctaatttttgtatttttagtacagacggggtttcaccatgttggccaggccggtcttgaactcctgacctcgagtgatcccccccacctcggcctccgaaagtattgggattatgagtgagtcaccgtgcctggttttcagtttttatgtggtgcttaaagcaagccactcaggtacagagactctcagggcgagcactcgtgtgctcaaaccccgggataagagttgccctccttgggggcttcagggcgctcaaggtccaggccctggccaggggcccaggctgtggggggtagggactgactgggtgcctggggagctgggagtggacgggggacctggcatttggggagacttcaggcacaggagggacttcaggccaggcctgcggcagggcaggacggcgccggtgttcacgcaggcgcgcgaaagaaaaggagcgcccgggcctggctctcttcccggcttctttcctgacttggcctcctgggtctcctccgccatcacggcctcctcctcaccctcacaccccctccctccagccgcacactcagagcctggagacgctgaacctgggccacaaccccatcgggaacgagggtgtgcggcacctcaagaacgggctcatcagcaaccgcagcgtgctgcgcctcgggctggcctccaccaagctcacgtgcgagggcgcggtggcggtggcggagttcatcgctgagagcccccgcctcctgagactggaccttcgggagaacgagatcaagacaggcgggctcatggcactgtcgttggccctcaaggtgaaccactcactgctgcgcctggacctcgaccgtgaacccaagaaagaggcggtgaagagcttcatcgagacgcagaaggcgctgctggccgagatccagaacggctgcaagcgcaacttggtgctggcgcgggagagggaggagaaggagcagccgccacagctgtcggcctccatgcctgagaccaccgccaccgagccccagcccgacgacgagcccgccgctggggtgcagaacggggcccccagccccgcacccagcccggactcagactcagactcggactcggatggggaggaagaggaggaagaggaaggggagagggacgagaccccctgtcctgccctggtgccccccacggactccctgggccctggggacaggagtcccccaggcagcccctccacacccaccgagcagcggatttccgtgtccagcccgggccggggccacaaggtgtttgtggtgacccgggtggagagcccgcccgagagggcagagccccctgcgtcccccacccctccctctcccccaccccctccctccccacccgcctcaccttccctaccaccagccggggccattgacacccgggacacagggtcctctgagcctcagccaccaccggagccgcctcggtcagggccaccactgcccaacggcctgaagcccgagttcgccctggcactgccccctgagccgcccccggggcctgaggtcaaggggggcagctgcggcctggagcacgaactgagctgctccaagaacgagaaggagctcgaggagctgcttctggaagccagtcaggaatccgggcaggagacactgtgacactttagttccctttttccggtcggtctgcgatgagctgaggccagagccatgagaatctgctcaccttccccccagccttcctgaggcccaggatgccaggggtgggggccattctggggcccccctccccccacagcaacactacaaggggtgcaggagctacagggagtggccctccgcgcgtgactcaagcacttctatttatgagcccagcactggaagactctgggggtgaatgggaggagggggagcaggaggaggaggaggtctccaaggacatcaggcgcctgttctggaggggccaggcttgccctgcggagggcaggcgtcctgggtggtggtgggatggtcccctgtggccccgggcacagggccgggcaggcagcctggtgccggagaggcggtgcgtgctggtggtggttgagatgcgcagaacagccccagacagcgcaggccgggcagggtggggggatgggagcagaggatcagagctttctttttctcaagtgcaataaatctatcagggagctggggcgggagcagccggcactccgggaccctgctgtccaggccactggaggctgcgccctgagaggcactacagccctttgggggcgagtggcatgggtgtgggtgagggtgggcagagggctggggctactcctgtcggtgcaactctgttcacaccttttctaataaactggggctgggttaaaaaaaaaaaaaaaaaaaaaaaaaaaaaaaaaaaaaaaaaaaaaaaaaaaaaaaaaaaaaaaaaaaaaaaaggagggggcgcgcgccgccccaaaaattcccccgccgggggcggcgccccgaacgcgccccccccgttttttggcaaaagggggccccccaagggggggtttattaaaacggaaggcgcggggagcgcgcgatagtataataaaacagcgtcgtcgggggcggggaagaaaacgcggctgtgcggggaggaatacctgtgtgggggagggaggggacccccataatagtctggggggggggggaggagaaaatatggtggggcaacaactctccatccctagaaggagatatttgaaacgcgtcctggggaggaagaattaataaaattttcgaggggggattatatggtgtggtgtacacaagacaggagggataatagggcggtggggggaggatgaaagatatttggtgccatacgggaatgatagttttcgaggacaaatttttttacgggg

SEQ ID NO: 736989 - DNA, 5508 bp, Homo sapiens
cagattcgctgctcacgtttcttttttccgtggcccttcctgccctttgtttctctcttcatgtcacccgcgggacaactctacgtgcaagtcgctgaaatcgattttctgcttcttatagtaagcggcgggctcgccagcctcgagcgaaagtgtgactgcgaacgggcaggcgcgcgcggggctcggcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatggtgagaagcttgactacaagacctgtgaggccctggaagaggtcttcaagaggctgcagttcaaggtcgtggacctggagcagacaaacctggatgaagatgtgagcggccctgccaccgcccacttggctccctgagctcccgggccccttcgagggtgcctcggccctcttcgacatgatcgagtactacgagtcggccacccacctcaacatctccttcaacaagcacatcggcacccggggctggcaggcggccgcccacatgatgcgcaagacgagctgcctgcagtatctggacgcccgcaacacgcccctgctggaccactcggcgcccttcgtggcccgtgccctgcgcatccgcagcagcctggcagtgctgcacttggagaacgccagcctgtcggggcggcccctcatgctgctcggtgagccccaagcccgggagggtgagcaggatgtgcagcctgttggggggcaggggcctgcccagtcaccgtgccccctccccgtccccagccacggccctgaagatgaacatgaacctgcgggagctgtacctggcggacaacaagctcaacggcctgcaggactcggcccagctgggtaacctgctcaagttcaactgctccctgcagatcctggacctccggaacaaccacgtgctagactcgggtgggtgcagtggcccaccccacccacacccgtcacccagcacccactctgcccggccctgcgctaggtggtgctggggacacagacatggccaagaccaccccaacgctgtcctgctggggctcccaggaggaagacagacccgccctagacagtgacaacctagagtgggcaggactgggctggtggagcccagaggcggggtccgatcagtctgggggccagggagggcttccaggaggaggagacagctcagctgacagccgcaggatgaggcgaagtgaataattacaatctgaaaagaaagcagtgttgctgccataacagggtcagctagaggctgctttcagatgggagaggagggaagaccaccgtggggcggggcctctgggcttccatccggaggctgggagcagaaccagccttgtgagaagcctgggaaagggtccagaccgcgggagcagtgagtgcagtgggaggagctctggtgtttgatgctgggggttgagcagagaatggggagccgtcaaaggaggcgttcctgttgcatcctggaggggtggggtgggtcactgtgtccccaggtggcaggcccagaccccactctactgagcacctgccaagggccatggctgtcggcccctgggctcagctcggagggagacacagggctctgcccttgggagtttgtactccagtctagagagacaacgataagatgagtgaaatctccagcctgtcagatggtgggatctgcattggagggagacagtggtgactgtgggtgggagtgagctggctgtgaggtgaggtgggccagaggtggtcacatttgagcaaagatcagaagcatctggtggaggctgtcatccaggcacccaggcccaggggtcacagatgtgtgcccaggggtgccaggccgaggcagggctgcagggcaaggcctgggactgcggggcctccatggaggtcctaagcagagggggttgctcctaccctgcagtcccctccccaggaagcacccggaccccagacagggctctgactgccggcctcctccaggtctggcctacatctgcgagggcctcaaggagcagaggaaggggctggtgaccctggtgctgtggaacaaccagctcacgcacacaggcatggccttcctgggcatgacactggtgagtcaggctggcagggaagggaggcacctcggtccccgctgccacctcccactccagctctcagcacagttgcctctagctgacggctcctgtcctgcccatcctgcaggttcaagacgatttaaactcagccccacctgcttcctcattcagcttctgtgcctgttttccctgaggaggagcccttctttcattatctcctttttttttttgagaccgagtctcatcctgtcacccaggctggagtgcagtggcgccatctaggctcactgcagccactccagcccccgcctcctgggttcaagccattcttctgcctcagcctcccaagtagctgggactacaggtgcccgccaccccgcctagccaatttttttattttttatttttattttttttgagacggagcctcaatcgcccaggctggagtgcagtggctcgatctccgctcactgcaagccccacctcctgggttcacaccattgtcctgcctcagcctcccgagtagttggaactacaggcacccaccaccacacccagctaatttttttgtatttttttagtagagaggggatttcaccatgttagccaggatggtcgcaatctgaccttgtgatccaccctcctcggcctcccaaagtgctgggattacacgcgtgagccaccgcgcccggcctaatttttgtatttttagtacagacggggtttcaccatgttggccaggccggtcttgaactcctgacctcgagtgatcccccccacctcggcctccgaaagtattgggattatgagtgagtcaccgtgcctggttttcagtttttatgtggtgcttaaagcaagccactcaggtacagagactctcagggcgagcactcgtgtgctcaaaccccgggataagagttgccctccttgggggcttcagggcgctcaaggtccaggccctggccaggggcccaggctgtggggggtagggactgactgggtgcctggggagctgggagtggacgggggacctggcatttggggagacttcaggcacaggagggacttcaggccaggcctgcggcagggcaggacggcgccggtgttcacgcaggcgcgcgaaagaaaaggagcgcccgggcctggctctcttcccggcttctttcctgacttggcctcctgggtctcctccgccatcacggcctcctcctcaccctcacaccccctccctccagccgcacactcagagcctggagacgctgaacctgggccacaaccccatcgggaacgagggtgtgcggcacctcaagaacgggctcatcagcaaccgcagcgtgctgcgcctcgggctggcctccaccaagctcacgtgcgagggcgcggtggcggtggcggagttcatcgctgagagcccccgcctcctgagactggaccttcgggagaacgagatcaagacaggcgggctcatggcactgtcgttggccctcaaggtgaaccactcactgctgcgcctggacctcgaccgtgaacccaagaaagaggcggtgaagagcttcatcgagacgcagaaggcgctgctggccgagatccagaacggctgcaagcgcaacttggtgctggcgcgggagagggaggagaaggagcagccgccacagctgtcggcctccatgcctgagaccaccgccaccgagccccagcccgacgacgagcccgccgctggggtgcagaacggggcccccagccccgcacccagcccggactcagactcagactcggactcggatggggaggaagaggaggaagaggaaggggagagggacgagaccccctgtcctgccctggtgccccccacggactccctgggccctggggacaggagtcccccaggcagcccctccacacccaccgagcagcggatttccgtgtccagcccgggccggggccacaaggtgtttgtggtgacccgggtggagagcccgcccgagagggcagagccccctgcgtcccccacccctccctctcccccaccccctccctccccacccgcctcaccttccctaccaccagccggggccattgacacccgggacacagggtcctctgagcctcagccaccaccggagccgcctcggtcagggccaccactgcccaacggcctgaagcccgagttcgccctggcactgccccctgagccgcccccggggcctgaggtcaaggggggcagctgcggcctggagcacgaactgagctgctccaagaacgagaaggagctcgaggagctgcttctggaagccagtcaggaatccgggcaggagacactgtgacactttagttccctttttccggtcggtctgcgatgagctgaggccagagccatgagaatctgctcaccttccccccagccttcctgaggcccaggatgccaggggtgggggccattctggggcccccctccccccacagcaacactacaaggggtgcaggagctacagggagtggccctccgcgcgtgactcaagcacttctatttatgagcccagcactggaagactctgggggtgaatgggaggagggggagcaggaggaggaggaggtctccaaggacatcaggcgcctgttctggaggggccaggcttgccctgcggagggcaggcgtcctgggtggtggtgggatggtcccctgtggccccgggcacagggccgggcaggcagcctggtgccggagaggcggtgcgtgctggtggtggttgagatgcgcagaacagccccagacagcgcaggccgggcagggtggggggatgggagcagaggatcagagctttctttttctcaagtgcaataaatctatcagggagctggggcgggagcagccggcactccgggaccctgctgtccaggccactggaggctgcgccctgagaggcactacagccctttgggggcgagtggcatgggtgtgggtgagggtgggttttatttttctttttctgtgttaacttttgatctagatttttttctttagactttttattgtattacttttattatatgatcatattatgtctctaattgttgcatttttcgttatgttgttgatcatatgctttta

SEQ ID NO: 736990 - DNA, 5745 bp, Homo sapiens
cagattcgctgctcacgtttcttttttccgtggcccttcctgccctttgtttctctcttcatgtcacccgcgggacaactctacgtgcaagtcgctgaaatcgattttctgcttcttatagtaagcggcgggctcgccagcctcgagcgaaagtgtgactgcgaacgggcaggcgcgcgcggggctcggcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatggtgagaagcttgactacaagacctgtgaggccctggaagaggtcttcaagaggctgcagttcaaggtcgtggacctggagcagacaaacctggatgaagatgtgagcggccctgccaccgcccacttggctccctgagctcccgggccccttcgagggtgcctcggccctcttcgacatgatcgagtactacgagtcggccacccacctcaacatctccttcaacaagcacatcggcacccggggctggcaggcggccgcccacatgatgcgcaagacgagctgcctgcagtatctggacgcccgcaacacgcccctgctggaccactcggcgcccttcgtggcccgtgccctgcgcatccgcagcagcctggcagtgctgcacttggagaacgccagcctgtcggggcggcccctcatgctgctcggtgagccccaagcccgggagggtgagcaggatgtgcagcctgttggggggcaggggcctgcccagtcaccgtgccccctccccgtccccagccacggccctgaagatgaacatgaacctgcgggagctgtacctggcggacaacaagctcaacggcctgcaggactcggcccagctgggtaacctgctcaagttcaactgctccctgcagatcctggacctccggaacaaccacgtgctagactcgggtgggtgcagtggcccaccccacccacacccgtcacccagcacccactctgcccggccctgcgctaggtggtgctggggacacagacatggccaagaccaccccaacgctgtcctgctggggctcccaggaggaagacagacccgccctagacagtgacaacctagagtgggcaggactgggctggtggagcccagaggcggggtccgatcagtctgggggccagggagggcttccaggaggaggagacagctcagctgacagccgcaggatgaggcgaagtgaataattacaatctgaaaagaaagcagtgttgctgccataacagggtcagctagaggctgctttcagatgggagaggagggaagaccaccgtggggcggggcctctgggcttccatccggaggctgggagcagaaccagccttgtgagaagcctgggaaagggtccagaccgcgggagcagtgagtgcagtgggaggagctctggtgtttgatgctgggggttgagcagagaatggggagccgtcaaaggaggcgttcctgttgcatcctggaggggtggggtgggtcactgtgtccccaggtggcaggcccagaccccactctactgagcacctgccaagggccatggctgtcggcccctgggctcagctcggagggagacacagggctctgcccttgggagtttgtactccagtctagagagacaacgataagatgagtgaaatctccagcctgtcagatggtgggatctgcattggagggagacagtggtgactgtgggtgggagtgagctggctgtgaggtgaggtgggccagaggtggtcacatttgagcaaagatcagaagcatctggtggaggctgtcatccaggcacccaggcccaggggtcacagatgtgtgcccaggggtgccaggccgaggcagggctgcagggcaaggcctgggactgcggggcctccatggaggtcctaagcagagggggttgctcctaccctgcagtcccctccccaggaagcacccggaccccagacagggctctgactgccggcctcctccaggtctggcctacatctgcgagggcctcaaggagcagaggaaggggctggtgaccctggtgctgtggaacaaccagctcacgcacacaggcatggccttcctgggcatgacactggtgagtcaggctggcagggaagggaggcacctcggtccccgctgccacctcccactccagctctcagcacagttgcctctagctgacggctcctgtcctgcccatcctgcaggttcaagacgatttaaactcagccccacctgcttcctcattcagcttctgtgcctgttttccctgaggaggagcccttctttcattatctcctttttttttttgagaccgagtctcatcctgtcacccaggctggagtgcagtggcgccatctaggctcactgcagccactccagcccccgcctcctgggttcaagccattcttctgcctcagcctcccaagtagctgggactacaggtgcccgccaccccgcctagccaatttttttattttttatttttattttttttgagacggagcctcaatcgcccaggctggagtgcagtggctcgatctccgctcactgcaagccccacctcctgggttcacaccattgtcctgcctcagcctcccgagtagttggaactacaggcacccaccaccacacccagctaatttttttgtatttttttagtagagaggggatttcaccatgttagccaggatggtcgcaatctgaccttgtgatccaccctcctcggcctcccaaagtgctgggattacacgcgtgagccaccgcgcccggcctaatttttgtatttttagtacagacggggtttcaccatgttggccaggccggtcttgaactcctgacctcgagtgatcccccccacctcggcctccgaaagtattgggattatgagtgagtcaccgtgcctggttttcagtttttatgtggtgcttaaagcaagccactcaggtacagagactctcagggcgagcactcgtgtgctcaaaccccgggataagagttgccctccttgggggcttcagggcgctcaaggtccaggccctggccaggggcccaggctgtggggggtagggactgactgggtgcctggggagctgggagtggacgggggacctggcatttggggagacttcaggcacaggagggacttcaggccaggcctgcggcagggcaggacggcgccggtgttcacgcaggcgcgcgaaagaaaaggagcgcccgggcctggctctcttcccggcttctttcctgacttggcctcctgggtctcctccgccatcacggcctcctcctcaccctcacaccccctccctccagccgcacactcagagcctggagacgctgaacctgggccacaaccccatcgggaacgagggtgtgcggcacctcaagaacgggctcatcagcaaccgcagcgtgctgcgcctcgggctggcctccaccaagctcacgtgcgagggcgcggtggcggtggcggagttcatcgctgagagcccccgcctcctgagactggaccttcgggagaacgagatcaagacaggcgggctcatggcactgtcgttggccctcaaggtgaaccactcactgctgcgcctggacctcgaccgtgaacccaagaaagaggcggtgaagagcttcatcgagacgcagaaggcgctgctggccgagatccagaacggctgcaagcgcaacttggtgctggcgcgggagagggaggagaaggagcagccgccacagctgtcggcctccatgcctgagaccaccgccaccgagccccagcccgacgacgagcccgccgctggggtgcagaacggggcccccagccccgcacccagcccggactcagactcagactcggactcggatggggaggaagaggaggaagaggaaggggagagggacgagaccccctgtcctgccctggtgccccccacggactccctgggccctggggacaggagtcccccaggcagcccctccacacccaccgagcagcggatttccgtgtccagcccgggccggggccacaaggtgtttgtggtgacccgggtggagagcccgcccgagagggcagagccccctgcgtcccccacccctccctctcccccaccccctccctccccacccgcctcaccttccctaccaccagccggggccattgacacccgggacacagggtcctctgagcctcagccaccaccggagccgcctcggtcagggccaccactgcccaacggcctgaagcccgagttcgccctggcactgccccctgagccgcccccggggcctgaggtcaaggggggcagctgcggcctggagcacgaactgagctgctccaagaacgagaaggagctcgaggagctgcttctggaagccagtcaggaatccgggcaggagacactgtgacactttagttccctttttccggtcggtctgcgatgagctgaggccagagccatgagaatctgctcaccttccccccagccttcctgaggcccaggatgccaggggtgggggccattctggggcccccctccccccacagcaacactacaaggggtgcaggagctacagggagtggccctccgcgcgtgactcaagcacttctatttatgagcccagcactggaagactctgggggtgaatgggaggagggggatgggagcagaggatcagagctttctttttctcaagtgcaataaatctatcagggagctggggcgggagcagccggcactccgggaccctgctgtccaggccactggaggctgcgccctgagaggcactacagccctttgggggcgagtggcatgggtgtgggtgagggtgggcagagggctggggctactcctgtcggtgcaactctgttcacaccttttctaataaactggggctgggttaaaaaaaaaaaaaaaaaaaaaaaaaaaaaaaaaaaaaaaaaaaaaaaaaaaaaaaaaaaaaaaaaaaaaaaaggagggggcgcgcgccgccccaaaaattcccccgccgggggcggcgccccgaacgcgccccccccgttttttggcaaaagggggccccccaagggggggtttattaaaacggaaggcgcggggagcgcgcgatagtataataaaacagcgtcgtcgggggcggggaagaaaacgcggctgtgcggggaggaatacctgtgtgggggagggaggggacccccataatagtctggggggggggggaggagaaaatatggtggggcaacaactctccatccctagaaggagatatttgaaacgcgtcctggggaggaagaattaataaaattttcgaggggggattatatggtgtggtgtacacaagacaggagggataatagggcggtggggggaggatgaaagatatttggtgccatacgggaatgatagttttcgaggacaaatttttttacgggg

SEQ ID NO: 736991 - DNA, 1396 bp, Homo sapiens
ccccccccccccctccgagatcgtaactcgggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctaaaaaagcacagacacacaaaaaaacgacca

SEQ ID NO: 736992 - DNA, 1412 bp, Homo sapiens
ttgtaggatttgtgactgccggaataagagaaaggggggggtcgagggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctaaaaaagcacagacacacaaaaaaacgacca

SEQ ID NO: 736993 - DNA, 1754 bp, Homo sapiens
aaggctcttttcttggttgtaccctgaatcctagagataggaattggtccttctcacctgcttcttgaccccttccctgcatgctgatggtgctttggatccctgttctttctggctcaaagattttgcttcccactgctttttccagggttctagccctgggaatgatgattggcgctttcttgctaatataatgacatgagccaccagattgctgggttttaaatacattagtaggctattgtaacaagcaagtttggggcttgctttttccctcgaaagatcttattaagggatgggatccttgctgcagattagtagcagaaagattatttctcaggggatgagaggctggataactgtagtaatgctcttgctgtttcctacaggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctaaaaaagcacagacacacaaaaaaacgacca

SEQ ID NO: 736994 - DNA, 2389 bp, Homo sapiens
gaaattgcttttaaagatataatattttatagggctatatctgcccaataattagcagctttaaaccagtcatacctgtcaccaaacagtacaaacgaaaccacaataaaaaatgatcttttgagctccctcttataatccctatatatcccaaaagtcatatccattatgttaattgtaataatagtttattgtaatcaatgtgcaatatatgaatcaatttatcccatcagattacacagtctgtgtgagcactgtaagaatgttagtaacagatacggtatgcacaaacataggagctcatgtgtacttttaaaacctcatccttgaggatatattaataatagaaataaatcagcattctttatgactcaagtagtataaatcaataggtagagtaggatgtgaaatgaaatgtaggttgttactacattttttacatctaaaattgaggtctttctactgtaaattatttatagagtttgggaatgttgaatatataccacaaatgtaatttgctaaattgttaggaagtactgataactatacaccacacacactaaaaatccttatttgactctgttgagtgaagggagatttcactttaaaggcagtgaggaagacatggaagaattgtttttgaggaaaatattatttgagtttgccataatgtagagcaatgctctctgataaagccctccttctatggtgatggaaatgttctatatctgcactgtctaatgtggaagccgctaactacatgtggctgttgaacaattgaaatgtggctagtgtactgaggaactgaatttttatttaattcattttaattcaataaatttaaacttaatgtggctgtggctaccacattggacaatgcagctctagagattttatgtctgagtgattaggataacatgccaacagtacagtgaacactttaaaaggtagatatttacagaatctctcatagaccttttttcttcttttcttttttcctatttgaacttgttttgttagttgggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctaaaaaagcacagacacacaaaaaaacgacca

SEQ ID NO: 736995 - DNA, 1054 bp, Homo sapiens; identical to SEQ ID NO: 427522

SEQ ID NO: 736996 - DNA, 1020 bp, Homo sapiens
ctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagagggtaatttaaattttgtttgatgattagtatgtgg

SEQ ID NO: 736997 - DNA, 2388 bp, Homo sapiens
ctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggagcttattatttttaaattatacgaaa

SEQ ID NO: 736998 - DNA, 4328 bp, Homo sapiens
ctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaagggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctaaaaaagcacagacacacaaaaaaacgacca

SEQ ID NO: 736999 - DNA, 4297 bp, Homo sapiens
ctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctaaaaaagcacagacacacaaaaaaacgacca

SEQ ID NO: 737000 - DNA, 2955 bp, Homo sapiens
ctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaactttttattctccctcaagctctgctactcaaatgtccagtacctgttgcaaagtaggaaagccaaaactaagtggaatggaattgatgaattgattggttctgctaatgcagttgcctttcgttataataaaacattataaaaccttttgg

SEQ ID NO: 737001 - DNA, 2263 bp, Homo sapiens
tcgacgatccccgtgtgcggaccatcctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaagggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctaaaaaagcacagacacacaaaaaaacgacca

SEQ ID NO: 737002 - DNA, 3051 bp, Homo sapiens
cccattcatttatattttttatttccagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaagggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctaaaaaagcacagacacacaaaaaaacgacca

SEQ ID NO: 737003 - DNA, 2462 bp, Homo sapiens
tcaaccatgggattcggctacattgcaaaacagacaactcttaagatgcttatgtattcacacctatgtgtccttcctgatgctctttctcttcatttgtcaaatctttcttaccttcatctaactcaattttatcttctcctttaagtttctgtttttgcagtcaaaagtgatcgtgcctgtcttttattctaatggcaattttgtagtaattttttacttacattgcatttatatctccttctgtagactataagatctaattctttttcatctttttattgctacatactttgtacatagaacttaattgttggatgaatgagtagataaaatagtgattaaattaatggtgtaatcttttgttttatagccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaagggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctaaaaaagcacagacacacaaaaaaacgacca

SEQ ID NO: 737004 - DNA, 1951 bp, Homo sapiens
tttgtgtttcatatgtaaaactgatcaagtgcaatttaacaattttttaatttcgtttttcccctttttatgttgtatgtgactgtatgactgtactcaaagagcttttaaagcagtataaattgttttcttgtctttccagttgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaagggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctaaaaaagcacagacacacaaaaaaacgacca

SEQ ID NO: 737005 - DNA, 1915 bp, Homo sapiens
gaaattggctaagtgtgtaaattatttactcagttacatgaagcacatagttcttttgaatagacaccctataaacctttgacatttttattgtcctagtatgagtgacccatcacagaaaagaattgaattcaaatagtatttttactgaaggaagaactaaagaagcagcagaaatacttttggatgcaaagtgtcttgattgctcttatttacaatctgtctgtaatttgaatgtaaaattatgttctgatttctcaatcaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaagggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctaaaaaagcacagacacacaaaaaaacgacca

SEQ ID NO: 737006 - DNA, 1510 bp, Homo sapiens
gtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatgggcccctgcactggtactggaaaaactcaccaggcaatggagaagaatgggtgggaagagagacggcccccatcagtcagctgagcacctagatgactttcgccaacctgctctattattatacttaggatagaaatggagggctcgtgttgacatccagtctcaatctttcatttggcggtaataaatcactcttatttcagatatgaataggtttctcactgaaacagatacatagatattgataataaacaatcaaaagaacaagcgtgcataa

SEQ ID NO: 737007 - DNA, 2700 bp, Homo sapiens
gtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatgacaaaaaaaatttctga

SEQ ID NO: 737008 - DNA, 1279 bp, Homo sapiens
gtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggcaagtgctcacgtgtgattgaatctaaaccttctgagtccatgaacacgcgacgtgttttgggagatagcggagaaattaacatcttaaccggtcaagctccactggctctggcaatattttaacagatgccaggaacatgggcacagaaatcaatgagatcagatggctggggctgaagaatgaaagctttattttttgtttttgcaattccgagattgtgtctctatatttgtgtcattttcattcagattgactgttgccttgagttttaatgtattgttgctttagaaaatgacatgacattctgtccggaaatgtttcctggcagctaaaaggaaaaagctgtatctacttaggtatgaaatgaagagaagcaaagagaacgaggtggtttatgtgataacagcaagctgctcatccaaataacccaggccaaaaatacactgtctacaaggttgtgccaactcagctttcatgtgaaccacaaaagggagtatcggtagacctcaggccaagaaaatacctttttccaggtttctgtgttaaatcaagaactgtactatgcatt

SEQ ID NO: 737009 - DNA, 2634 bp, Homo sapiens
gtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatgacaaaaaaaatttctga

SEQ ID NO: 737010 - DNA, 2745 bp, Homo sapiens
gtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggagagatggactcatggaaacctggatcggtccttttagatgaaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatgacaaaaaaaatttctga

SEQ ID NO: 737011 - DNA, 463 bp, Homo sapiens
  misc_feature (12)..(12): n is a, c, g, or t
  misc_feature (28)..(28): n is a, c, g, or t
  misc_feature (32)..(33): n is a, c, g, or t
  misc_feature (35)..(35): n is a, c, g, or t
  misc_feature (461)..(461): n is a, c, g, or t
tttttttttttntttttttttttttttntttnntntttttttttcttccttaaatacatgtttattttacttcaatatcgctcagggttgtatgtatttgaatacttcagtactattttgaacattctaaatatgaaataccataaagcgttcaaatttatcaaacagtggtacaatatggttactaaacttgcaacttaatttacaatgacgttcaatttttcctcttcaaataaaatcactgactttggtccatttgatgagaaactaggacatatgccatgacagcatacttctagcactctatgtaataagcaaaagataatttagctaatatagacaggttacctgactgaaattctactttctgcttaattgatcacgatcaagaaaactacaaaaaaaaaacaaaaaacaaaacaaaacaactaccacagacctcgtgccgaattcctgcagcncg

SEQ ID NO: 737012 - DNA, 1529 bp, Homo sapiens
  misc_feature (12)..(12): n is a, c, g, or t
  misc_feature (28)..(28): n is a, c, g, or t
  misc_feature (32)..(33): n is a, c, g, or t
  misc_feature (35)..(35): n is a, c, g, or t
tttttttttttntttttttttttttttntttnntntttttttttcttccttaaatacatgtttattttacttcaatatcgctcagggttgtatgtatttgaatacttcagtactattttgaacattctaaatatgaaataccataaagcgttcaaatttatcaaacagtggtacaatatggttactaaacttgcaacttaatttacaatgacgttcaatttttcctcttcaaataaaatcactgactttggtccatttgatgagaaactaggacatatgccatgacagcatacttctagcactctatgtaataagcaaaagataatttagctaatatagacaggttacctgactgaaattctactttctgcttaattgatcacgatcaagaaaactacaaaaaaaaaacaaaaaacaaaacaaaacaactaccacagactacagctctcagccaagaaagtaatgatatataagccgggcgcggtgtctcatgcctgtaagcctagcactttgggaggctgaggtgggtggatcgcctgaggtcaggagttcaagaccaggttggccaacatggtgaaaccccatctctactaaaaatacaaaaattagccaggcatggtggcaggcgcctgtaattccagttactagggaggctgagacaggagaatcacttgaatccgggaggcaaaggttgcagtgtgtcaagatcacaccactgcactccagcctgggcaacagagtgagacttcatctcaaaaaagaaaaacaaagaaatatgtggtacagatattgctcttcttcaggtaacatacataaaatccaatgttatatactaaaataataatccacaaatccaaacattgttataattatacaacaggtgactgatagtagataactaggaacagactgcatttgacaagattttctttaataacatcataaacatccctaatatgatgaaagaccaagagctataatcaagatgaatatgccaaaacagccaaggagctagtagctagtcttcagacaggctacgagtttgttttataggaccactccgcccttgggtctggtgacactttaagttttctaggcaggagtgaaaaggagttaataatgccaattccaggtataaatacaaatgagaggcacatagtagtaggcataaccaaaatccaggccaaatttttggctcaaaggtgatctgcaatagttccatgatcagttatttataatttcagcttactataaagttgacttccaggtcaaaggcaaattttcctttcacattacctcataaaagccatttaagggctgggtgcctgcgtcacgcctgtaatcctaccactttgggaggccaaggcaggcggatcacctgaggtcgtgagtttgaaaccagcctgaccaatatggtgaaaccctgtctctactaaaaatacaaaaattgccgggcacggtggctcacacctgtaatcccagcactttgggagaccaaggtgggtggatcacgagatcaggagctcgag

SEQ ID NO: 737013 - DNA, 1446 bp, Homo sapiens; identical to SEQ ID NO: 7609

SEQ ID NO: 737014 - DNA, 833 bp, Homo sapiens
tggatttctggtgttggcaaggaaacgctttccaattccgtgattttacaagccagactaatttctttcaatttatcattttcactttttggagacaaaagagtcagatctaccttcttattcaaactatctgaacctttggaatttctatcttgagcattttggtcctcacaaaaactgagcttttgtgctttgtcttccagtaagtcaggaatctgaactgcaacagacccttctttagtctctttctcttcattcactggatgtgctgggaaattacctctatctgcatatccttctagggctctggcctctcctggtaggctctggtcttctactggcactccaggaaggaggtgaccttttgctagctctgtgactttctctactgaatgcttagacgcaccactgtgcactgactcagattctcctatcacatgcccttcatcgatccctgcttcatttttcatggaatcagcaagctcagctttattcttaagagagtgatctccatgaatgttaactgtttctatggctgttgtaataggtagagcaactcctcctgtgcttgtagagggcacaacagcagagggacccttgggtctttcttgacctgggactccatctttggtgtagttatctaccattaatgatttggaaatctgggctggggctatctcttgcccattttttgccaaggtatctggaaaggaatcaccttcctttactacttgaggagtaggagtgggcagtttttcacaggctgctgattccagaacctctagagagactcggtaccggcatcgaaattacaccgcggacgcctctatctc

SEQ ID NO: 737015 - DNA, 835 bp, Homo sapiens
tggatttctggtgttggcaaggaaacgctttccaattccgtgattttacaagccagactaatttctttcaatttatcattttcactttttggagacaaaagagtcagatctaccttcttattcaaactatctgaacctttggaatttctatcttgagcattttggtcctcacaaaaactgagcttttgtgctttgtcttccagtaagtcaggaatctgaactgcaacagacccttctttagtctctttctcttcattcactggatgtgctgggaaattacctctatctgcatatccttctagggctctggcctctcctggtaggctctggtcttctactggcactccaggaaggaggtgaccttttgctagctctgtgactttctctactgaatgcttagacgcaccactgtgcactgactcagattctcctatcacatgcccttcatcgatccctgcttcatttttcatggaatcagcaagctcagctttattcttaagagagtgatctccatgaatgttaactgtttctatggctgttgtaataggtagagcaactcctcctgtgcttgtagagggcacaacagcagagggacccttgggtctttcttgacctgggactccatctttggtgtagttatctaccattaatgatttggaaatctgggctggggctatctcttgcccattttttgccaaggtatctggaaaggaatcaccttcctttactacttgaggagtaggagtgggcagtttttcacaggctgctgattccagaacctctagaggagatgatttatttatcagctcttccccaccggcctgctacctgaccc

SEQ ID NO: 737016 - DNA, 1010 bp, Homo sapiens
tggatttctggtgttggcaaggaaacgctttccaattccgtgattttacaagccagactaatttctttcaatttatcattttcactttttggagacaaaagagtcagatctaccttcttattcaaactatctgaacctttggaatttctatcttgagcattttggtcctcacaaaaactgagcttttgtgctttgtcttccagtaagtcaggaatctgaactgcaacagacccttctttagtctctttctcttcattcactggatgtgctgggaaattacctctatctgcatatccttctagggctctggcctctcctggtaggctctggtcttctactggcactccaggaaggaggtgaccttttgctagctctgtgactttctctactgaatgcttagacgcaccactgtgcactgactcagattctcctatcacatgcccttcatcgatccctgcttcatttttcatggaatcagcaagctcagctttattcttaagagagtgatctccatgaatgttaactgtttctatggctgttgtaataggtagagcaactcctcctgtgcttgtagagggcacaacagcagagggacccttgggtctttcttgacctgggactccatctttggtgtagttatctaccattaatgatttggaaatctgggctggggctatctcttgcccattttttgccaaggtatctggaaaggaatcaccttcctttactacttgaggagtaggagtgggcagtttttcacaggctgctgattccagaacctctagaggagatgatttatttatcagctctgatggtgttctgggacaggtaaatgtaatatttctattttcgtccatataggccattccttcaattccctggtcccctgtggtttccatgggaacatgtatttttgttgcatctatcttattctccagaatgtgcttctcaggagaactatttttaacctttttactttttccatcattactccttttacttggtttgtc

SEQ ID NO: 737017 - DNA, 1357 bp, Homo sapiens
  misc_feature (719)..(719): n is a, c, g, or t
  misc_feature (767)..(767): n is a, c, g, or t
  misc_feature (917)..(917): n is a, c, g, or t
  misc_feature (927)..(927): n is a, c, g, or t
  misc_feature (929)..(929): n is a, c, g, or t
  misc_feature (942)..(942): n is a, c, g, or t
gttctaatttaaaattttgcaattctgattttaatctcatatattaaagtacacttctaagcatttatttggatagttatccacactctgtgcattagaaataacccagaagcatattaaaaatacacacgttgaaggcccacgtccataaattctgggcccaggcgtctgttctgttagcatatgtgatgttggaaaactactagtccagtgtctctcagacttcaaaatgcctaggaatcacctggggatcttgcctaaaaatccagattctaagtcagtcagtctgaggtgagtgcctgagattcggcgatcccgatcctaatgagctcccaagacgaggtagctgctgctggtgcatacatcacaccaatagcaaggcctgggcaccacacccagatgcagacgctcaccagctggcagctgggtccacactggagggcagggaaaataatcagactctttaggactgggcttccaacactaaaacatgaaatgattaacaacggactttacatacataatctcagttcatccacacatatacacactccataagatcattaccattttttatggttgaggaagccaagactcagaaagtcatacagctagaaagtatattggttgtctattgtggctttaacaaaggaccacaaacttagtggcttaaaatgagacaactttatgaccttatggttttgcagacaagaggttcnaaaatcaaggcattggcaaggctgtgtcccttttgggagctctagganagaatctgctttcttacctttccagtgtctagaggctgcctgcatttcttaattcgtggtccctttatccatcttcatgtcagcaacaccacatctctctgacactttttccttcatcacctctctctctaaccacagctgggaaaggtnctctgctttnanggattaagtaatnagactgcgcccacttggataatgcaagatactctcctctcctagagtctgtacctgaatcaaaatctgcaaagtcctttttgcccatgtaaatgaacatattccacagttgaatggggattagggaatacacatctttgggggaacattattctgccttccacagtgggaaaaaaacaggatttagagcctgaaagcaaattcaaatctgtctgattccaaagtccatgctcctagcacacaattcaaaagagtaactaaattgaatgttgttgtagtctggaggccaaatcatgaatggtgttaaagtgtatattctctgtacgcagcctgaatgccactatcattttaaattgaactgaatgatgctgaagtggattttgtttattgcaatgcgttttgcattctccttaggc

SEQ ID NO: 737018 - DNA, 1188 bp, Homo sapiens; identical to SEQ ID NO: 306093

SEQ ID NO: 737019 - DNA, 1156 bp, Homo sapiens; identical to SEQ ID NO: 306094

SEQ ID NO: 737020 - DNA, 521 bp, Homo sapiens
tagaggatcccggtcattgctacaccaatagctagtgattctaatactcagcaaatgcctggttctgaagggtcacggggctgtcaacaggtgttccttactcataattgattattcaaacctttaagttagctttccataattcactgcacttaaataagtttaaatcaaatacagttattttagttacaggttaggaagatggtctttaaataaccaaaaatatgtttattttttattatagtgtagacatacccttcatctattatatcataatacatgttacattggactgaattagattttcccatttctaatagttggcaccattataagctataaggttcagaatcagaattttagtaacaactcaagagaaagttgttgaatataatccttagtgaaaacagtgtcctctaaccaatgcctatacaactaaatttatgctgggtttttggttttgtttttttaaaaatatttttatgtgttcaaactattttggtaaatttttagcaaaaaaa

SEQ ID NO: 737021 - DNA, 438 bp, Homo sapiens; identical to SEQ ID NO: 306095

SEQ ID NO: 737022 - DNA, 2536 bp, Homo sapiens; identical to SEQ ID NO: 306096

SEQ ID NO: 737023 - DNA, 1569 bp, Homo sapiens; identical to SEQ ID NO: 306100

SEQ ID NO: 737024 - DNA, 1836 bp, Homo sapiens; identical to SEQ ID NO: 306098

SEQ ID NO: 737025 - DNA, 956 bp, Homo sapiens
agatcttaacggctaggtagcgaggcctgggtgttgtgagttatttctgttggccgcattaggaacctgacatttgattcattcagtgggtcctgcctaggtcctttaaaacagaatggactgttagggaaaggctgccctgggccatgcaggccgaggagaccaaggggattggaataaccagtatggcaaaatgcttggtcaagatccagactcgacgaagcctccaattgcacatggtgaaccactgcaacagtaatgtgtttgttcgtctgctgagactcggctccaaggtcacagctcgtaacactggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccatgttccagcctccgtctgtgactgggtgggtaagttcggtgggccccacccagtgggctcggcagccgtcacttcacagaagaagaaaggaaccttgcttaggcctcagatcccagctgtgctctccaatccattaataaagctgcttttaaccctctcctggccattgtatctattatctactgggaactggggtggcggcagggatggtggtgaatattttggatctcggcaacctccaatg

SEQ ID NO: 737026 - DNA, 1499 bp, Homo sapiens
cacatgtgtgtccagctgggtgtgcacacatgagttaatcaggagatgtcaggggaggaaaaaggctgtggaaatgtcctagattaaagaggacaggacccccaagatgcaggaaggactctggactggaccctgttccgtaaatcatcataagttatttccttgtccttaggaaataactcaggacaaagggccaagatgaatgcaacctattcttaaatgattcagagaaaatactatgttattatatattatacatacagcatacatatagagtgagagagctgtgtacagacacacagctgctaaacacttgtatgggtgtctttgtacttattctagtaactttaagcttaaaattctttacaaataaaatgttaaaaaaaatgagaaggctaataagcacatgagaagcttaacgtcatgattcattaggggaatgcaaggcaaaaccatgatgagatgcccctagacacctcttagaagagctgctaagaaggcagacagcaccaagcgctaaatgagatggggcacctggtgctcttctgtgctactggtaggggtgcagcagagtggtcagtctggacagtagctgacatcacgtgacccaacacacgcattcctggctacttaccaaggagaatagaaagcaggcagatctctacagcagctctctacctgattgcaaaacaatggaaatgcccacatgtccacaaacaagtgtgtggtctgcctgtgccatgaagcacagtgtggctgagcgtcaagagtccccacactcaaaggaggcagcagatacagggctgcacactgtgtgattccacacatgtgacattctggacacggacatgctggatggcaaaacgagcatcgggctgagaggactgctgagaaggggaacggggctgctgggatgtgggttgattgtagcagtagctcatggagatgtgacctcaaaagagtgatttttactatgtgcatactatacctccacaaacttgactttaaaaaaataaaatattcacagaaaaaaacaaaaacaaatgtaaaaccatcagactactttatcagaggtgttatttttagatagaggtctttgaactccatcctaggaacattgtacccatgtcctcccagaactgcatcttgcactgggtgtcggaagacagccctgcaagacctgtatgctctgtaccattcagtggtttttaaggttaactaccagaagtcatatctgaggcctcccagaagcattactctaaggaaagtagttaaatgtggacagtgacagcagaaacatttacacattaaaccagtttatagaacatgagaatgttcagagcataaagaagcttgtcagctcaatgacttacgaggcgtgggccattaaaaaaaaaggtctggagtttgggaaggagaaaggaatggggatctgcagctcagagtgagagatggaattctgtaaaggaacagtgtggagagggactccaggcaagtca

SEQ ID NO: 737027 - DNA, 1517 bp, Homo sapiens
cacatgtgtgtccagctgggtgtgcacacatgagttaatcaggagatgtcaggggaggaaaaaggctgtggaaatgtcctagattaaagaggacaggacccccaagatgcaggaaggactctggactggaccctgttccgtaaatcatcataagttatttccttgtccttaggaaataactcaggacaaagggccaagatgaatgcaacctattcttaaatgattcagagaaaatactatgttattatatattatacatacagcatacatatagagtgagagagctgtgtacagacacacagctgctaaacacttgtatgggtgtctttgtacttattctagtaactttaagcttaaaattctttacaaataaaatgttaaaaaaaatgagaaggctaataagcacatgagaagcttaacgtcatgattcattaggggaatgcaaggcaaaaccatgatgagatgcccctagacacctcttagaagagctgctaagaaggcagacagcaccaagcgctaaatgagatggggcacctggtgctcttctgtgctactggtaggggtgcagcagagtggtcagtctggacagtagctgacatcacgtgacccaacacacgcattcctggctacttaccaaggagaatagaaagcaggcagatctctacagcagctctctacctgattgcaaaacaatggaaatgcccacatgtccacaaacaagtgtgtggtctgcctgtgccatgaagcacagtgtggctgagcgtcaagagtccccacactcaaaggaggcagcagatacagggctgcacactgtgtgattccacacatgtgacattctggacacggacatgctggatggcaaaacgagcatcgggctgagaggactgctgagaaggggaacggggctgctgggatgtgggttgattgtagcagtagctcatggagatgtgacctcaaaagagtgatttttactatgtgcatactatacctccacaaacttgactttaaaaaaataaaatattcacagaaaaaaacaaaaacaaatgtaaaaccatcagactactttatcagaggtgttatttttagatagaggtctttgaactccatcctaggaacattgtacccatgtcctcccagaactgcatcttgcactgggtgtcggaagacagccctgcaagacctgtatgctctgtaccattcagtggtttttaaggttaactaccagaagtcatatctgaggcctcccagaagcattactctaaggaaagtagttaaatgtggacagtgacagcagaaacatttacacattaaaccagtttatagaacatgagaatgttcagagcataaagaagcttgtcagctcaatgacttacgaggcgtgggccattaaaaaaaaaggtctggagtttgggaaggagaaaggaatggggatgtgacctcaaaagagtgatttttactatgtgcatactatacctccacaaacttgactttaaaaaaataaaatattcacagaaaaa

SEQ ID NO: 737028 - DNA, 738 bp, Homo sapiens
agtacaaagagcaggcataaatgtcacaccccttttgggcggaagtattactaaattaagtgtcagatcatgagctgaagtaagaatactatgtttattctatatgaaggcaataactaatttatgtacaatctctgttttgcagtttcttaaacttaagtgaggaagaattttgacacatttgtggaaagcactcctcccattttccgattaaaaactgattttttttcctagaggaagatatggcaatgcttcccaaacattctgaaaaacatagtcctcaaacatagtttcacaaataatgttttaaaaaggtaccctcaaaaaataaatttttgaaaaaggtatataatattaacttggaaaatactggattgaagaaaatataactagattctctccttcaagatgtcacaggcttttgatattctagggtgcactgtgattttctaagataggaataaaatatacactgcttcccaaatttatttgaccatgaaaccatttttattcttgatttaccttttgaaactacaaggctaattcaggaaacagtgacttctttcatgcacttttctagtgttggtcaagccagtttaccaatattgaatgtttactgcacataagatactctgctctgttataggttcttatttaaaggaaaaacatagtctctttacttaagggaaaaacaaaaaaattgtaattatctaatgagagaaataattgacaaatgat

SEQ ID NO: 737029 - DNA, 139 bp, Homo sapiens
tttcttcgagagcagaccatttctcttcctgagtgtgccacacagatgtttttctttctgggctttgcatccaacaactgtttcatcatggccgctatgtcctacgaccgctacacggccatccacaacccactgcaga

SEQ ID NO: 737030 - DNA, 1006 bp, Homo sapiens
gtaagctggatatttaaagggattgcagtctttgctgatgagactaagcatatgacgacaggaatgagtgtgagagagaacctcaagaaactgaaaggccagactctcagagggtgaatattgaagtcaccaagaattatgacagaagtgtgagtgcctgggtttgaatcctgatactatgtacttaccaggtatatgtccttgggcaagttatataaccttagtttcctcatcagttaaaatgaggataatgatagtatagttctctgaattatcaggagtaaacaatttaatacttatgaaactcttagtatgtggtatatggcaaatgacatataaatgtttataatattatcagaatcataataaccattattatttgtatgatccagtcctgtgtgagtctccgcttttcattcactagaaatttattaagcgactatttcatgccaggcattttgctaggtatcctgttaaaacttctgaattattttatttggctgttttaggcttcaggaatttcaagtggaacagaaataatatactgcagcctcaccaaaataaaagttattcttgaagtctttgccatgagttctccttgctgaattaaaatgctgtttagtaaggatacagacccagggggaaatggagcaaaccaaagcagtgattacttggatctctatactggacaggctcactgtagcaaaagagatgcttagaagcagactcagctgtaggacatgaaagagaatctaaccatatttttgaggcatggtggtgtccaaaatgtatggtgataggagatgggaagcagcgaagataaaaagttatccttgtggtgttccaacttgaaacagtgggttaatgtctggtagtcaggttaaacacagagagctaccattttggaggttggctgtcaagatatagacacttggatgttaggaaataagatagagatccagttactgagtaaaatcacttatatgattatcttctttaaaaaaaa

SEQ ID NO: 737031 - DNA, 1338 bp, Homo sapiens
atatgatactgggcatatggcaatgctcagtgaatattggacagctaatacaatttgcagagtcactgaggaaaagtatagcttcagagagcttctgtgtccagatttcaacgattttctttcatcattatttcgtggggctcccaggaccatatgtggctcacaaaccacaggctaggatgtgtttaacgttaaaagcaagcagtgtgtttctctgaagtgtggctccaccatggtgttcggttacacccagaggaggaggctggtgggcagtcatagaagtgcatcttccagagcaggaagggatcaacagctcttcctgggagacttccattctcctaccccagtttctgaggcacagcatggaatctaggagggagtttctcttcttgctttttcctcctagttttgtttcctctatcccttttccttgctaaagtgtgttggatggtcaggaatgtgggcggagaagagggggagctggagacatctcatcctttcatccagcttgtgtaaaaatgcctcagaactccctcataccacatgcaccataaattataaggtcaagctttgtaagcctgcagccctcttggctttttgcatgttggttagaatgcctaaatagaaagcctctgttaatgttgattgcctcttgtctgttccaggttggcaaggcccccagtggccaaggcatgagcctggatgccctgcaaattgagtacgtgttagggatgggggccattctttatagtttgactctggagagctaggaccacctttcccagcctcaggggtgcacatcctcaggagctgcctacctccagatattgtaagtccatgcagaagaggaagggcccagctggggcacctcttggttgaggaatgagtatgtgacattttcatgtgggcacattttgatactactttaaaaatagaccaagcacagtggctcacacctgtaattcccagcacttcgggacgctgagagaggtggatcacctgaggtcaggagttcgagatcagcctggcccaacatggagaaaccccgcctctactaaaaatacaaaacattagctgggtgtggtggcacacacctgtaattcccagctactcgggaggcagaagcaggagaatcgcttgaatccaggaggcggaggttgcagtaagccgagatcacgccactacactccagcttacactggacatgatgaggaggaggaggatgatcttctgcacggtaggtgatcttctgcacgatgaggtgatcttctgcacgataaggtgatcttctgcacgatgaggtgatcttctgcacgctaaggtgatcttctgcacgat

SEQ ID NO: 737032 - DNA, 1335 bp, Homo sapiens
atatgatactgggcatatggcaatgctcagtgaatattggacagctaatacaatttgcagagtcactgaggaaaagtatagcttcagagagcttctgtgtccagatttcaacgattttctttcatcattatttcgtggggctcccaggaccatatgtggctcacaaaccacaggctaggatgtgtttaacgttaaaagcaagcagtgtgtttctctgaagtgtggctccaccatggtgttcggttacacccagaggaggaggctggtgggcagtcatagaagtgcatcttccagagcaggaagggatcaacagctcttcctgggagacttccattctcctaccccagtttctgaggcacagcatggaatctaggagggagtttctcttcttgctttttcctcctagttttgtttcctctatcccttttccttgctaaagtgtgttggatggtcaggaatgtgggcggagaagagggggagctggagacatctcatcctttcatccagcttgtgtaaaaatgcctcagaactccctcataccacatgcaccataaattataaggtcaagctttgtaagcctgcagccctcttggctttttgcatgttggttagaatgcctaaatagaaagcctctgttaatgttgattgcctcttgtctgttccaggttggcaaggcccccagtggccaaggcatgagcctggatgccctgcaaattgagtacgtgttagggatgggggccattctttatagtttgactctggagagctaggaccacctttcccagcctcaggggtgcacatcctcaggagctgcctacctccagatattgtaagtccatgcagaagaggaagggcccagctggggcacctcttggttgaggaatgagtatgtgacattttcatgtgggcacattttgatactactttaaaaatagaccaagcacagtggctcacacctgtaattcccagcacttcgggacgctgagagaggtggatcacctgaggtcaggagttcgagatcagcctggcccaacatggagaaaccccgcctctactaaaaatacaaaacattagctgggtgtggtggcacacacctgtaattcccagctactcgggaggcagaagcaggagaatcgcttgaatccaggaggcggaggttgcagtaagccgagatcacgccactacactccagcttacactggacatgatgaggaggaggaggatgatggtggtgattatgatagaaatggtgatggtgatgatgacaatggtgatagtagggatggtcttgctctgtcgcaatcaataaatgaatgcataaacacaaaaaaaaaa

SEQ ID NO: 737033 - DNA, 655 bp, Homo sapiens
actcactgttgggttgagaccagttgattctgttcccccaatcccttacccctccccagaagtcccctttcttggtcaggtaccacctcctgctggtggcacagaagaagtggccacaatccgggtgtcgggagttggaaataacatcagctttgaggagaagaaaaaggttctaattcagaggcaggggaacggcacctttgtacagactgacaaacctctctacaccccagggcagcaagtgtatttccgcattgtcaccatggatagcaacttcgttccagtgaatgacaagtactccatggtggaactacaggatccaaatagcaacaggattgcacagtggctggaagtggtacctgagcaaggcattgtagacctgtccttccaactggcaccagaggcaatgctgggcacctacactgtggcagtggctgagggcaagacctttggtactttcagtgtggaggaatatgtgctgccgaagtttaaggtggaagtggtggaacccaaggagttatcaacggtgcaggaatctttcttagtaaaaatttgttgtaggtacacctatggaaagcccatgctaggggcagtgcaggtatctgtgtgtcagaaggcaaatacttactggtatcgagaggtggaacgggaacag

SEQ ID NO: 737034 - DNA, 328 bp, Homo sapiens; identical to SEQ ID NO: 158487

SEQ ID NO: 737035 - DNA, 1972 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctcctgacttactgtgtgcttcttggtcaaccgccagagaatgcaggtgaggagcatgtgcccgagggatgaggcaatgaacacaatgaaagcattttcgtggatggtgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcaccccacagtcagtggccaccgtgtactcaaagtggaacaccagggaccagatgatgcagaagaagaagccgaacacaggaaaagtgatggcccaccagaccatggctgtgaagcgaagccggaacaaggtcccatcggggtccaaaggctgggaggccgcagagaacatcctgcagggcgtggccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacccacgcggtggtggcgagagtgccggcggaacccgggggcccaggtggcccggggtcgggggctggctctgcgggctggtcagagcgcgaacggcgggttttcgcgattggtaaggcc

SEQ ID NO: 737036 - DNA, 3001 bp, Homo sapiens
  misc_feature (3000)..(3001): n is a, c, g, or t
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctgtgtttggtcaatgtgtagatgggttcagatgctctacacccatagctcagagctgtacctccactaagaccctgggtgagttccaaggcctcagattcagtccagaggacagggatgagtcacagaccatctgagcttccttagaacagtgctggattcactgctcagctaagatgttcctcagtctgctcccagcgccactcactcctctaggcaggtgtgccaaggtggtagaatggcacccctgctctgatcatgattaacaaagtgggtgggctgggcacgatggctcacatctgtaatcccagcaagaatatggatttttaaaagtttccaaaactgtggaaatggccagtccattgcccacactttctgtgcacttctgcagacctccaacgagggccagcgcagtgccagagcccagcaacccagcaagggaatgaatttgctcnn

SEQ ID NO: 737037 - DNA, 1210 bp, Homo sapiens
gtcacatgacgactttatcgaccgaccgacgcctgttgcgctgcgcggcgtaatgtactcgatccacgaggtgtgtccgccgtcgctcatcagtttagcgacgtatggtgttggccctcgctttgttgtcacgctggtgggtgtgtgccctcgttttgtgcttcctgtatggtttgttggcctcccctcgctagtggggctggagataccccgcacctttgggtgctccgggggcgaaacccccggctgtgagccgtgcccgctgtgcgtatgcccagcgtatctcggcgtggtaagccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctcctgacttactgtgtgcttcttggtcaaccgccagagaatgcaggtgaggagcatgtgcccgagggatgaggcaatgaacacaatgaaagcattttcgtggatggtgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctctcccaaaagacctctccttccaggtcctaggcccaaagtgctggattctcattccccagctatcctgggatttgtgcagcagcatggtggcaccttctccatctcccccgcagactggaacctgcccacgcggtggtggcgagagtgccggcggaacccgggggcccaggtggcccggggtcgggggctggctctgcgggctggtcagagcgcgaacggcgggttttcgcgattggtaaggcc

SEQ ID NO: 737038 - DNA, 274 bp, Homo sapiens
aaaagaaaaaagaaagtgggtgctcctaacctggggtagtctaaggaaatgaccatgttcttgtgcatctccaccatccatcttaatgcctggaactcctattgaagcttcagtccttaaggaaaaaggagaagataatacacagctgcagggactggtgtcttgcttgtttgagaggtgaaaggatgggggatgactgtacaagggtttagatggggacacggaagccaaagatgggagaggctctcttaacatcagccggatccactagagc

SEQ ID NO: 737039 - DNA, 1414 bp, Homo sapiens
attttgttttgtttttgagacagggttttactcctgtcacccaggctggagtataatggtgtgaactcagctcactgaaatgtccacctcccagcctcaagcaattctcctgccttagcctcccaagtagctgggactacaggggcatgccagggcacccagctaatttttttgcattttttgtacagacggggtttcaccatgctgcccaggctggtctcgaactgaactcgagtgatccactggcttcgccctcccgaggtgctgagattacaggtatgagccactgcgcccgtcatctcccttgcatttctatcatcatcttccaactcagggagggctgtgattctattctctctgagtctccccccatgaattatctctgactctgacttacctacccttcccccatccccttgtccctttccctctctctgatcctccacttcctctccactatctaattctaccctaactgccacctcctgacctggccctgacccaggggctggggagctggcactcaccccacagtcagtggccaccgtgtactcaaagtggaacaccagggaccagatgatgcagaagaagaagccgaacacaggaaaagtgatggcccaccagaccatggctgtgaagcgaagccggaacaaggtcccatcggggtccaaaggctgggaggccgcagagaacatcctgcagggcgtggcctaagcagcacgagggatacaacttggggcctggtaggacacctgggtctgggaaagtggggccttttccagagatggctcctcagagtataaggaaaagccagagcagaaagggtagaaaaggcataaggggaaaaggaagacagtgcagaggagaaggatcagagggagatggggcaggagcagcagagacaggcagggtcagagcttaggaatccccctggcacagtgatactctaggtccacctcttgaagagcctacagaagagaggctcccggtggcttggacagggagctctggtggcccacctcactctcacaaccctcatagccactcaggagaagggtcagaggtagaaaggttattattcccatttcacagaaggggagactgaggcccagaactatgccaggatcaacaccaggactaaggcctcttgccacctgacagcttcaggttctaagtcatggcttctttcaggccaactaacaaaggaccgttggctcagaatggccaaagccctcccactgaccctgtctgaccacattcctgttccttacccaagttcaactaggaacagagggagtgccccagagcctatttcaatggggccacaggctgccagccattccacccccaggctctgaatgatccaagcctcaggccagcggtaccctgatcctaaaataccaggtccctgtgg

SEQ ID NO: 737040 - DNA, 309 bp, Homo sapiens; identical to SEQ ID NO: 288156

SEQ ID NO: 737041 - DNA, 337 bp, Homo sapiens; identical to SEQ ID NO: 405551

SEQ ID NO: 737042 - DNA, 1139 bp, Homo sapiens
cgcgcatgcgcctctgtgcgtttgtcccatgctggttccgtgagtctggccttaggtgtctcgtgtctggggttgatccgagctgtcgccgccgccgccgcaatgggcaaaacggccaactctccgggttcgggagcccgacccgacccggtgcggagcttcaatcgctggaagaaaaaacacagccataggcagaacaaaaagaagcagttgaggaagcaactgaagaaacccgaatggcaggtcgagcgcgagagtatcagccgcctcatgcagaactatgaaaagataaatgtaaatgaaatcacaagattttcagattttcccttgtccaaaaaaacattgaaaggtttgcaagaagctcagtaccgtttggtgactgagatacagaagcagaccattggattggctttgcaaggtaaagatgtacttggagcggccaaaactggatctggcaagactctggcttttcttgttccagtgctggaagccttatatcgtctgcaatggacttcaacagatgggctgggggttctcataatatcacctacgagagaactggcctatcagacctttgaggttctccgaaaagtaggaaagaatcatgacttctcagctggtctcatcattggtggaaaggatctaaaacacgaagctgagaggatcaacaacataaatatactcgtgtgcacaccaggtcggcttcttcaacacatggatgaaacagtatcttttcatgctaccgacctccaaatgttagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcc

SEQ ID NO: 737043 - DNA, 556 bp, Homo sapiens
ctagaggatcccccaaagatgccatcgactggatttattttgaagagttttgccacttttgggattataaggaacaaatcacaggaaaagccagaatcagtaagctatataaagggcttgttgcattccactgtcactacacatttagcctggtagcttcctgttttcttttctttttattttttaaatagagatggggtctgtatgttgaccaggctggccaacatggtgaaacaccgtctccactaaaaatagaaaaattaactgggtgtggtggagggcgcctgtaatcccagctaatcaggaagctgagacaggaggatcgcttgaacccaggaggcggaggttgcagtgagccgagattgctccattgcactccagcctgggcgatagagtgagactcagcctcaaaaaaaaaaaaaaaaaaaaaattccggcagggggggggggggcgcctataaccccagttactcgggaggcagaggacaagaagggctggatcattggacccggggaggcagagtcacaaggacgcgagatgggccatggactcaag

SEQ ID NO: 737044 - DNA, 596 bp, Homo sapiens; identical to SEQ ID NO: 405570

SEQ ID NO: 737045 - DNA, 1006 bp, Homo sapiens
cgcgcatgcgcctctgtgcgtttgtcccatgctggttccgtgagtctggccttaggtgtctcgtgtctggggttgatccgagctgtcgccgccgccgccgcaatgggcaaaacggccaactctccgggttcgggagcccgacccgacccggtgcggagcttcaatcgctggaagaaaaaacacagccataggcagaacaaaaagaagcagttgaggaagcaactgaagaaacccgaatggcaggtcgagcgcgagagtatcagccgcctcatgcagaactatgaaaagataaatgtaaatgaaatcacaagattttcagattttcccttgtccaaaaaaacattgaaaggtttgcaagaagctcagtaccgtttggtgactgagatacagaagcagaccattggattggctttgcaaggtaaagatgtacttggagcggccaaaactggatctggcaagactctggcttttcttgttccagtgctggaagccttatatcgtctgcaatggacttcaacagatgggctgggggttctcataatatcacctacgagagaactggcctatcagacctttgaggttctccgaaaagtaggaaagaatcatgacttctcagctggtctcatcattggtggaaaggatctaaaacacgaagctgagaggatcaacaacataaatatactcgtgtgcacaccaggtcggcttcttcaacacatggatgaaacagtatcttttcatgctaccgacctccaaatgttagttcttgatgaagcagatagaatcttggatatgggctttgctgataccatgaatgctgttattgaaaatctccccaagaaacgtcagactttacttttctcagcaacacaaactaaatctgtaaaggaccttgcacgcttgagtttgaaaaaccctgagtatgtctgggttcatgaaaaagcaaaatatagaagagcattaagaagttggttttgaagaaccttaataatagcaatctcttttctcc

SEQ ID NO: 737046 - DNA, 294 bp, Homo sapiens
gtaggtgtactgactaatttcttttcttttgctactatctaaataacaaagcatgcttttccaactgcagataaacgaagaaaggaatcaggtaagtgagtgctggtttggcattttgtggtgtgagttgacagctactgtaaatcattatggctaagacttgattagtgctgcaaaaaatccataaaaatcttattttagtttgtttaaactttcttgtactttacttttcagcaaaactgctcattgaaagtcatctcattgaatcctaatgacctgtcagttaggtctagg

SEQ ID NO: 737047 - DNA, 1225 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactgttgtgaggacacaaggaacaggacatggtgaacttccagctacccgctcagaggcctcttgataaatcacaccaccattggtctgccacagagaacacaatggcagccagtccccaagaccattgcccattatcaaaaacatcattgctgccccgcagccactcatgaccgcctgtggatcctatcctggcctca

SEQ ID NO: 737048 - DNA, 4264 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtaagcacttgatatcatgttagattatactgaggagagacag

SEQ ID NO: 737049 - DNA, 5002 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggtacatataaaaagcaggtttggctctcttaaagttacactgactataccacacgttattctcctgattcgtatgattggaaatatttaaaagttctcaggtaagcggtagcttgatgtgaagtaccagagggaaaggtttaaagtcctggatatggcttgagataattagtaggcatgtaaattgcctttcatttactttggattacttcagcaatagctgagaaaccataaaggaaacacatttggttaagtaacacattgtatgaggccaggtttcaaacctgtggtagcatacagaagataattggttattcttatttttgtcgttgttggtttgt

SEQ ID NO: 737050 - DNA, 5480 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacaggtaagaaactgctaccatgagatctaggaagtgacacagcttgactttctagtttctggaacttgagagatctgtttgattatgttactggaattaagaagtctaccttttcgtttttccagttgcgtttataagacattcccagcagttatgctttaccaggctttaaaatattggcatgtttgtgttagaagctgtatgctcccttttctacaaaatgtcctctgatagtcctggtctttttgggatttttagtatttaatgtgagaattgtcatgaggacattaactttcagtttccccatgttacttttgtaacagggatttgagaccttaaactgttcatcaaagtaagccctaatagaaaggcagagcaataagagcacatgctgatgtaattctcctttgcaaggagaatttcatttagttccattgtcatatagaccagtgtcaccccttttccctgattcctactgttaacaactatttttcagtgcctttgaagatactgacccttctacctgcccagctgtttttaaacagctggagcgtgatgatggtcataaaatatataagtgttttagcatgtacagtaaaactaggttgtttagttaaacatagagttttgcctactttttcaattcgtttgactgcaggtgtggtcatttagttgcaaaccatttccatagtctgcttccactgtccagttaatctgttttttttttc

SEQ ID NO: 737051 - DNA, 7239 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcaggtagagaaaaaaggacagtgaatttgaatggaatccgtgataccgaagttgaaagcaagtcattcagctaatacaaagctgttttatgacccttggaactttgaagagtacaaacattggcaatcacgttgaaacaagtgcaagggagggcgtgaggtcttgcaggcatctgtctttttactggagagatttaaagaattctcttgctgtttggattattcctctacagattgtcatttttaaaccctttgttctctctcatttggacttgctgaattctctgctcagtgattaacttaagatttgctcatgtgggttcatgcacagtaaattctgcctttattgactacctgatgtgcagtttaatctttttctttacctccatggttttttaaaagttaaattagctttctgaaagggtttttaatctccatttttttaaagttgtttgcttatacttcgggtaaccttgatatttgtattttaatagtacataatctttatgaaaaatagtttgggaatgtaaatgaattattatttggcttggggagattagggcctacattgtttatcgcaattacttgtatcattgatacgggatttctttgtaaagcatcctctacctctcagctgctgaaagctagacctttggtattttccatgctataattcttatggctgctgaaatgtgtggtttttatgatttattaaataatctcttaggaggcatttctggagaatgtgtgtatatacatgtttgcgcgtacaggggaggggagggtatgataaatgtgggaaactggaaatatattgacttttatgtttataatcttggtagcatttagaatgcccctaagaaatctccattgacaaatgaaatgctatagacttggttttccagttatccatattcattttgtctgtcatatgctttgtatcatctccttctttcctaattttttataaccttatatatatatttattataaatatatgtatttctgaggga

SEQ ID NO: 737052 - DNA, 7305 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaaccgtgagtcacatttcttgatgctttttgagaaaggcaacatgataggtgaaaaaaactaatcaggaggatagggccctgctttgtcatctttctagagagagagagagagagagagagtgtgtgtgtgtgtgtgtgtgtgtgtgtgtgtgtgtgtgtgtttttgagtctcagttttgctctgtttcccaggagaatggtgtgaacccgggaggcggagcttgcagtgagctgagatcgcgccattgcactctagcctgggcaactgaatgagactcagtctcaaaaaaaaaaaagagagaaaagaa

SEQ ID NO: 737053 - DNA, 7569 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggtggggaaggcatatggtccttctctgcgcctctgtcgccttcctactcactgcctcctaccgctccccgct

SEQ ID NO: 737054 - DNA, 10037 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctg

SEQ ID NO: 737055 - DNA, 9882 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctg

SEQ ID NO: 737056 - DNA, 9815 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctg

SEQ ID NO: 737057 - DNA, 7744 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaaccttgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcaggtatatgtggccaatagagccaagcaaaaatcttgctgggtgttaaagtattgtcaaattgaagcggagccaggaaatctgatgggaaactatcctttactccttcctctggacaaggctacttccccaagtgtctgtttttattttattaaatatcatgagattccacagttga

SEQ ID NO: 737058 - DNA, 9728 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttgcctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctg

SEQ ID NO: 737059 - DNA, 9691 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttgcctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctg

SEQ ID NO: 737060 - DNA, 8879 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttgcctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttgaaaaaaaaatatataatacaaa

SEQ ID NO: 737061 - DNA, 8902 bp, Homo sapiens
tgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtgcagctgaggtagtggttccagtaggcgaaggccaccaagaagcgaggcgccgagtgcaggccgatgcagaaacgccacacgtagcgctggggcacctccccgccgatggctgagctcaccgagggcaggtaattgggcacctagagagttgtgacctgtctgggcatctgcctctgccagccccgcccatgtggagaaccttctctccatctgacaaaatcactcttgcctctgctccagcccctccccttccaagaagtcctccttcagatgtccccatacctctcccaaaagacctctccttccaggtcctaggcccaaagtgctggattctcattccccagctatcctgggatttgtgcagcagcatggtggcaccttctccatctcccccgcagactggaacctgcctggggtagtctaaggaaatgaccatgttcttgtgcatctccaccatccatcttaatgcctggaactcctattgaagcttcagtccccacagtgtgtggccgttgtctccttgaagtggaagagcagggaccagaggatgcagaagaggaaggcgacaagtggacagcagaccgtgaccagggccaccatggtgaagcggagccgtaccagggtcccatcccgatccagtggtagtgggacctggtacatcttgtcagacctctcagctgcgttccatctaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgtgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttgcctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttgccgatgcgacaaggtttatatttctccctattactacgaccaaca

SEQ ID NO: 737062 - DNA, 1529 bp, Homo sapiens
  misc_feature (982)..(982): n is a, c, g, or t
gtgctaggcagtgaacacagggtatgaacttgaaaatctgattgcaccctcaatatctggaatatacactgatctatgacctgaaattgtatggactgcagcaatccaaggggacactaagcagggtttgagtaatgctacaatggatttataggtcattttggagaaggtgttccacatcattagggagtctgggtttcccagatgtgcctgttttatcctttttattttaaataacatcactgtctttcctaactaaaaattcttcatcttcaggaaataagattgagatacggactgaaaatataaaattagcaataatgtttattattagatacttcctcaattaaatttctccctgaaagtcttagggcaaaagcccctgtctcttacttcatatatcaagtttggaggggaaagacataattgcatagcagtattccatgaatataacttaatggggaactggcttcagagttcagcaatattgggaagtcttgtcaaatattaagtcattcatatgttcaaaaatattaatatgtattgagcatctaccatcaaatatttaatatgataatgccatactggatattatatacgagttacaataattcttcctaaagtcagggaaagcttcacagataaggttgagctgaaggtttggcaggcagggaagcaaggagaagttagcagagagaaaagcacaagcaacaccatggaggaacaaatgtgggcaattcaggtaactcgagtaatttagtgttactatgcatatggcctatggaggccaggagtgtaaatgtattatggctggggcggggggctagggaatgtgttatgactaaattgtatcccttcagaattcatattttgaagcactgatctccagtgtgtctgtgttcagaggcaggtcccatagggaggcaattaaggttacatgagatcataaaggtgaggccctaatcctataggtctgctgtcnttacaagaagaggaagagccaccggagctggctcattctgcacgtgtacagagaagaggccatgtgaggacacgcagaggctcgaatatgctctcaaccctatcagttgcctgctttaattcatcccatggaattgttttgtcttttcgacccctcggctatgttatttgtattgtgatataggggatattcggagtcctctgagacgggacaaggacactggacggtctattgtgccatgcttatatattttctgtatacaatgctttctgtataaaaccagtaatacctgagaaacaacagtaacttgacaaaattactattgatcacttaactttatgtatcacgtaagttaaactttatttatttacatgtgtctccctcattagatgctaagttccttgatattttatacatttgtgaattcctggtaattcacatgaagcttgatgcattgtaagtattctgacctggtgaaataaatatacgaatgggcaaaaaaatatatactaaaatgatcaaataaaggttgtgttcagaaacctct

SEQ ID NO: 737063 - DNA, 341 bp, Homo sapiens
gctcggtaccccttttggggtctttgctctagtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcaaagaccccaaaaggggaaccgagctcga

SEQ ID NO: 737064 - DNA, 1043 bp, Homo sapiens
tagatgacaaatagtttttatttacttttgctctaagtagttcttctaactttgaataaaatgtctcttacatcatgaactaaatgaaatttgacatgccaaggctattccaggaggctgaaagtttggaggcagtaattctctactggggctgtctgccttaggacaaaattcactttattttgctttaggcccagttctaaggtttcccactagaaacaaattgctttttataccacagttcttatacaattatacatttggtagaatttataaggtgacaattgccaagaaatacagcctgaacacaggtgcagagtagagagagactgaaattcttcttggacccagcacttgagcagggataatttatgagtagttctgtttgccacactaaagcaacaccacccccagaatttcacaactcttgtttctcctcagttggcaaatgttgtttttggtttgctagttctgttttataaagatgtaaaagacttgcagtctttcatttaaaagacatccaactgagagagcgcgagtggaaatcatcgtgaatataattacaatgtgggcagtaataagcatttatactgcaagtttaatcatttacagctgacacatttaagagcccatttagttaccttgaacaaaagcaacagtgtggcatagtggttctcaatcctggctgactttagaatcacctggggagctttaaaaaggaaaaaaagagttcatgggcacagctcctggagactttgatttattctgtctgaggcagggctcaggcctctgtgtttaaacgccccagatgattctaatttgtagtcagacttgagaatgaccggtaaagcagaaggagcatgcgtttagagtgaaacgttggctcttctcttagggatcggcagagacttcactctcacaggctggcacggtgactgctctctctggttccaaaagcaaggtcagcctcatgaggcacctgcaacctcggcttttcctggggacaggattaagaatttttccactcattcgtttatttgacg

SEQ ID NO: 737065 - DNA, 3806 bp, Homo sapiens
tctgataatcccactgtaacagtttcaagtaactattatttagcaccaaagtagggctcaggcttggcttggaggtattttcggccccaggagttaaagcactctcagaaagagaaaataattcttcatttacagattcttttatccattctgtagtctgatcaagagcacttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcagagagggcttctcactctattgcccaggctgatgtgcagtagccattcactggtgagatcatcacgcgctacagcatcaaactcctggcctcaagtgatccccctgcctcagcctccgaagtagctgggattacaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 737066 - DNA, 3722 bp, Homo sapiens
tctgataatcccactgtaacagtttcaagtaactattatttagcaccaaagtagggctcaggcttggcttggaggtattttcggccccaggagttaaagcactctcagaaagagaaaataattcttcatttacagattcttttatccattctgtagtctgatcaagagcacttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcagagagggcttctcactctattgcccaggctgatgtgcagtagccattcactggtgagatcatcacgcgctacagcatcaaactcctggcctcaagtgatccccctgcctcagcctccgaagtagctgggattacaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagatggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 737067 - DNA, 3750 bp, Homo sapiens
tctgataatcccactgtaacagtttcaagtaactattatttagcaccaaagtagggctcaggcttggcttggaggtattttcggccccaggagttaaagcactctcagaaagagaaaataattcttcatttacagattcttttatccattctgtagtctgatcaagagcacttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcagagagggcttctcactctattgcccaggctgatgtgcagtagccattcactggtgagatcatcacgcgctacagcatcaaactcctggcctcaagtgatccccctgcctcagcctccgaagtagctgggattacaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 737068 - DNA, 1268 bp, Homo sapiens
tctgataatcccactgtaacagtttcaagtaactattatttagcaccaaagtagggctcaggcttggcttggaggtattttcggccccaggagttaaagcactctcagaaagagaaaataattcttcatttacagattcttttatccattctgtagtctgatcaagagcacttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcacctgtgcttccccctctggggccctcaacctctcacaaaatggcattgaagctgcttccacacatgactgggtatcttcggccctgggcctcttcaaatcaggcaacttccactggctgtcagggtgatgcatgaaatcccgggtccagcacgtagacaagaggagaacggcgacggagtgaccccgggtcagggctctctgggcgtcccctcaccgagcacagcacagtcacctcgaaaactcaccagcccaacaaacccccccagccccagtgtcccccccaacgcgg

SEQ ID NO: 737069 - DNA, 1955 bp, Homo sapiens
tagatgacaaatagtttttatttacttttgctctaagtagttcttctaactttgaataaaatgtctcttacatcatgaactaaatgaaatttgacatgccaaggctattccaggaggctgaaagtttggaggcagtaattctctactggggctgtctgccttaggacaaaattcactttattttgctttaggcccagttctaaggtttcccactagaaacaaattgctttttataccacagttcttatacaattatacatttggtagaatttataaggtgacaattgccaagaaatacagcctgaacacaggtgcagagtagagagagactgaaattcttcttggacccagcacttgagcagggataatttatgagtagttctgtttgccacactaaagcaacaccacccccagaatttcacaactcttgtttctcctcagttggcaaatgttgtttttggtttgctagttctgttttataaagatgtaaaagacttgcagtctttcatttaaaagacatccaactgagagagcgcgagtggaaatcatcgtgaatataattacaatgtgggcagtaataagcatttatactgcaagtttaatcatttacagctgacacatttaagagcccatttagttaccttgaacaaaagcaacagtgtggcatagtggttctcaatcctggctgactttagaatcacctggggagctttaaaaaggaaaaaaagagttcatgggcacagctcctggagactttgatttattctgtctgaggcagggctcaggcctctgtgtttaaacgccccagatgattctaatttgtagtcagacttgagaatgaccggtaaagcagaaggagcatgcgtttagagtgaaacgttggctcttctcttagggatcggcagagacttcactctcacaggctggcacggtgactgctctctctggttccaaaagcaaggtcagcctcatgaggcacctgcaacctcggcttttcttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcaccgggtccagcacgtagacaagaggagaacggcgacggagtgaccccgggtcagggctctctgggcgtcccctcaccgagcacagcacagtcacctcgaaaactcaccagcccaacaaacccccccagccccagtgtcccccccaacgcgg

SEQ ID NO: 737070 - DNA, 2149 bp, Homo sapiens
tagatgacaaatagtttttatttacttttgctctaagtagttcttctaactttgaataaaatgtctcttacatcatgaactaaatgaaatttgacatgccaaggctattccaggaggctgaaagtttggaggcagtaattctctactggggctgtctgccttaggacaaaattcactttattttgctttaggcccagttctaaggtttcccactagaaacaaattgctttttataccacagttcttatacaattatacatttggtagaatttataaggtgacaattgccaagaaatacagcctgaacacaggtgcagagtagagagagactgaaattcttcttggacccagcacttgagcagggataatttatgagtagttctgtttgccacactaaagcaacaccacccccagaatttcacaactcttgtttctcctcagttggcaaatgttgtttttggtttgctagttctgttttataaagatgtaaaagacttgcagtctttcatttaaaagacatccaactgagagagcgcgagtggaaatcatcgtgaatataattacaatgtgggcagtaataagcatttatactgcaagtttaatcatttacagctgacacatttaagagcccatttagttaccttgaacaaaagcaacagtgtggcatagtggttctcaatcctggctgactttagaatcacctggggagctttaaaaaggaaaaaaagagttcatgggcacagctcctggagactttgatttattctgtctgaggcagggctcaggcctctgtgtttaaacgccccagatgattctaatttgtagtcagacttgagaatgaccggtaaagcagaaggagcatgcgtttagagtgaaacgttggctcttctcttagggatcggcagagacttcactctcacaggctggcacggtgactgctctctctggttccaaaagcaaggtcagcctcatgaggcacctgcaacctcggcttttcttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcaggtaagaagagcaaagtccctgactgggctggtgaccatgggtgctgagacacccactggggacaaggacaacttgtccagtttcttcacagttaaggtagcaggacaaccatctaagatttccc

SEQ ID NO: 737071 - DNA, 4632 bp, Homo sapiens
tagatgacaaatagtttttatttacttttgctctaagtagttcttctaactttgaataaaatgtctcttacatcatgaactaaatgaaatttgacatgccaaggctattccaggaggctgaaagtttggaggcagtaattctctactggggctgtctgccttaggacaaaattcactttattttgctttaggcccagttctaaggtttcccactagaaacaaattgctttttataccacagttcttatacaattatacatttggtagaatttataaggtgacaattgccaagaaatacagcctgaacacaggtgcagagtagagagagactgaaattcttcttggacccagcacttgagcagggataatttatgagtagttctgtttgccacactaaagcaacaccacccccagaatttcacaactcttgtttctcctcagttggcaaatgttgtttttggtttgctagttctgttttataaagatgtaaaagacttgcagtctttcatttaaaagacatccaactgagagagcgcgagtggaaatcatcgtgaatataattacaatgtgggcagtaataagcatttatactgcaagtttaatcatttacagctgacacatttaagagcccatttagttaccttgaacaaaagcaacagtgtggcatagtggttctcaatcctggctgactttagaatcacctggggagctttaaaaaggaaaaaaagagttcatgggcacagctcctggagactttgatttattctgtctgaggcagggctcaggcctctgtgtttaaacgccccagatgattctaatttgtagtcagacttgagaatgaccggtaaagcagaaggagcatgcgtttagagtgaaacgttggctcttctcttagggatcggcagagacttcactctcacaggctggcacggtgactgctctctctggttccaaaagcaaggtcagcctcatgaggcacctgcaacctcggcttttcttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcagagagggcttctcactctattgcccaggctgatgtgcagtagccattcactggtgagatcatcacgcgctacagcatcaaactcctggcctcaagtgatccccctgcctcagcctccgaagtagctgggattacaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 737072 - DNA, 4528 bp, Homo sapiens
tagatgacaaatagtttttatttacttttgctctaagtagttcttctaactttgaataaaatgtctcttacatcatgaactaaatgaaatttgacatgccaaggctattccaggaggctgaaagtttggaggcagtaattctctactggggctgtctgccttaggacaaaattcactttattttgctttaggcccagttctaaggtttcccactagaaacaaattgctttttataccacagttcttatacaattatacatttggtagaatttataaggtgacaattgccaagaaatacagcctgaacacaggtgcagagtagagagagactgaaattcttcttggacccagcacttgagcagggataatttatgagtagttctgtttgccacactaaagcaacaccacccccagaatttcacaactcttgtttctcctcagttggcaaatgttgtttttggtttgctagttctgttttataaagatgtaaaagacttgcagtctttcatttaaaagacatccaactgagagagcgcgagtggaaatcatcgtgaatataattacaatgtgggcagtaataagcatttatactgcaagtttaatcatttacagctgacacatttaagagcccatttagttaccttgaacaaaagcaacagtgtggcatagtggttctcaatcctggctgactttagaatcacctggggagctttaaaaaggaaaaaaagagttcatgggcacagctcctggagactttgatttattctgtctgaggcagggctcaggcctctgtgtttaaacgccccagatgattctaatttgtagtcagacttgagaatgaccggtaaagcagaaggagcatgcgtttagagtgaaacgttggctcttctcttagggatcggcagagacttcactctcacaggctggcacggtgactgctctctctggttccaaaagcaaggtcagcctcatgaggcacctgcaacctcggcttttcttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcagagagggcttctcactctattgcccaggctgatgtgcagtagccattcactggtgagatcatcacgcgctacagcatcaaactcctggcctcaagtgatccccctgcctcagcctccgaagtagctgggattacaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttctctttgaactgcgtttaattgaaagttgataaaaacatctagaaa

SEQ ID NO: 737073 - DNA, 4962 bp, Homo sapiens
tagatgacaaatagtttttatttacttttgctctaagtagttcttctaactttgaataaaatgtctcttacatcatgaactaaatgaaatttgacatgccaaggctattccaggaggctgaaagtttggaggcagtaattctctactggggctgtctgccttaggacaaaattcactttattttgctttaggcccagttctaaggtttcccactagaaacaaattgctttttataccacagttcttatacaattatacatttggtagaatttataaggtgacaattgccaagaaatacagcctgaacacaggtgcagagtagagagagactgaaattcttcttggacccagcacttgagcagggataatttatgagtagttctgtttgccacactaaagcaacaccacccccagaatttcacaactcttgtttctcctcagttggcaaatgttgtttttggtttgctagttctgttttataaagatgtaaaagacttgcagtctttcatttaaaagacatccaactgagagagcgcgagtggaaatcatcgtgaatataattacaatgtgggcagtaataagcatttatactgcaagtttaatcatttacagctgacacatttaagagcccatttagttaccttgaacaaaagcaacagtgtggcatagtggttctcaatcctggctgactttagaatcacctggggagctttaaaaaggaaaaaaagagttcatgggcacagctcctggagactttgatttattctgtctgaggcagggctcaggcctctgtgtttaaacgccccagatgattctaatttgtagtcagacttgagaatgaccggtaaagcagaaggagcatgcgtttagagtgaaacgttggctcttctcttagggatcggcagagacttcactctcacaggctggcacggtgactgctctctctggttccaaaagcaaggtcagcctcatgaggcacctgcaacctcggcttttcttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcagagagggcttctcactctattgcccaggctgatgtgcagtagccattcactggtgagatcatcacgcgctacagcatcaaactcctggcctcaagtgatccccctgcctcagcctccgaagtagctgggattacaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttcctcgtgccgaattcggcacgaggagagaactagtctcgagtttttttttttttttccttttaaatgaagaaaagctttgcttaagggttgcatacttttattggagtaaatctgaatgatcctactcctttggagtaaaactagtgcttaccagtttccaattgtatttagcttttggttggaatttgaaaaaaaaagaaacaaagaaaaagaaaacctaaataaaataggtgaaagttccctgactattcaggtgaatacacaaaaaatattaattatatattattattaattaattttatttatatattatattattctattctattatctatactttttatttttttttatttttctcttttctcttatactctttaaatataaaatatatcttctggtggggcctctcttccacatttccctttttggggcggtttcaaattatatgtgcccctttttaacaaactttgtctggg

SEQ ID NO: 737074 - DNA, 4509 bp, Homo sapiens
  misc_feature (4495)..(4495): n is a, c, g, or t
tagatgacaaatagtttttatttacttttgctctaagtagttcttctaactttgaataaaatgtctcttacatcatgaactaaatgaaatttgacatgccaaggctattccaggaggctgaaagtttggaggcagtaattctctactggggctgtctgccttaggacaaaattcactttattttgctttaggcccagttctaaggtttcccactagaaacaaattgctttttataccacagttcttatacaattatacatttggtagaatttataaggtgacaattgccaagaaatacagcctgaacacaggtgcagagtagagagagactgaaattcttcttggacccagcacttgagcagggataatttatgagtagttctgtttgccacactaaagcaacaccacccccagaatttcacaactcttgtttctcctcagttggcaaatgttgtttttggtttgctagttctgttttataaagatgtaaaagacttgcagtctttcatttaaaagacatccaactgagagagcgcgagtggaaatcatcgtgaatataattacaatgtgggcagtaataagcatttatactgcaagtttaatcatttacagctgacacatttaagagcccatttagttaccttgaacaaaagcaacagtgtggcatagtggttctcaatcctggctgactttagaatcacctggggagctttaaaaaggaaaaaaagagttcatgggcacagctcctggagactttgatttattctgtctgaggcagggctcaggcctctgtgtttaaacgccccagatgattctaatttgtagtcagacttgagaatgaccggtaaagcagaaggagcatgcgtttagagtgaaacgttggctcttctcttagggatcggcagagacttcactctcacaggctggcacggtgactgctctctctggttccaaaagcaaggtcagcctcatgaggcacctgcaacctcggcttttcttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcagagagggcttctcactctattgcccaggctgatgtgcagtagccattcactggtgagatcatcacgcgctacagcatcaaactcctggcctcaagtgatccccctgcctcagcctccgaagtagctgggattacaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttcgggctagtcggnaggatcctctagag

SEQ ID NO: 737075 - DNA, 4587 bp, Homo sapiens
tagatgacaaatagtttttatttacttttgctctaagtagttcttctaactttgaataaaatgtctcttacatcatgaactaaatgaaatttgacatgccaaggctattccaggaggctgaaagtttggaggcagtaattctctactggggctgtctgccttaggacaaaattcactttattttgctttaggcccagttctaaggtttcccactagaaacaaattgctttttataccacagttcttatacaattatacatttggtagaatttataaggtgacaattgccaagaaatacagcctgaacacaggtgcagagtagagagagactgaaattcttcttggacccagcacttgagcagggataatttatgagtagttctgtttgccacactaaagcaacaccacccccagaatttcacaactcttgtttctcctcagttggcaaatgttgtttttggtttgctagttctgttttataaagatgtaaaagacttgcagtctttcatttaaaagacatccaactgagagagcgcgagtggaaatcatcgtgaatataattacaatgtgggcagtaataagcatttatactgcaagtttaatcatttacagctgacacatttaagagcccatttagttaccttgaacaaaagcaacagtgtggcatagtggttctcaatcctggctgactttagaatcacctggggagctttaaaaaggaaaaaaagagttcatgggcacagctcctggagactttgatttattctgtctgaggcagggctcaggcctctgtgtttaaacgccccagatgattctaatttgtagtcagacttgagaatgaccggtaaagcagaaggagcatgcgtttagagtgaaacgttggctcttctcttagggatcggcagagacttcactctcacaggctggcacggtgactgctctctctggttccaaaagcaaggtcagcctcatgaggcacctgcaacctcggcttttcttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcagagagggcttctcactctattgcccaggctgatgtgcagtagccattcactggtgagatcatcacgcgctacagcatcaaactcctggcctcaagtgatccccctgcctcagcctccgaagtagctgggattacaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgaatgttgtgctggagaattacccacttctttgtaatagtattcgaggaaagtgccacacgctagaggaggtctggtcttgttggattgaactgcttcactactcttggatcttgaactacctggttacgctctt

SEQ ID NO: 737076 - DNA, 4498 bp, Homo sapiens
tagatgacaaatagtttttatttacttttgctctaagtagttcttctaactttgaataaaatgtctcttacatcatgaactaaatgaaatttgacatgccaaggctattccaggaggctgaaagtttggaggcagtaattctctactggggctgtctgccttaggacaaaattcactttattttgctttaggcccagttctaaggtttcccactagaaacaaattgctttttataccacagttcttatacaattatacatttggtagaatttataaggtgacaattgccaagaaatacagcctgaacacaggtgcagagtagagagagactgaaattcttcttggacccagcacttgagcagggataatttatgagtagttctgtttgccacactaaagcaacaccacccccagaatttcacaactcttgtttctcctcagttggcaaatgttgtttttggtttgctagttctgttttataaagatgtaaaagacttgcagtctttcatttaaaagacatccaactgagagagcgcgagtggaaatcatcgtgaatataattacaatgtgggcagtaataagcatttatactgcaagtttaatcatttacagctgacacatttaagagcccatttagttaccttgaacaaaagcaacagtgtggcatagtggttctcaatcctggctgactttagaatcacctggggagctttaaaaaggaaaaaaagagttcatgggcacagctcctggagactttgatttattctgtctgaggcagggctcaggcctctgtgtttaaacgccccagatgattctaatttgtagtcagacttgagaatgaccggtaaagcagaaggagcatgcgtttagagtgaaacgttggctcttctcttagggatcggcagagacttcactctcacaggctggcacggtgactgctctctctggttccaaaagcaaggtcagcctcatgaggcacctgcaacctcggcttttcttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcagagagggcttctcactctattgcccaggctgatgtgcagtagccattcactggtgagatcatcacgcgctacagcatcaaactcctggcctcaagtgatccccctgcctcagcctccgaagtagctgggattacaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaatccaggtggtcctggcgacgcaatcgagaggagaggcgatctccagaggaaacgggcggtatccatgggggcatgccgggactaagatcctagtatctgtcgagcactgaagtacaattgttgacgacaggccatagggtatgaggccctgttgggcctaggtgaggtgactaactgtcgtatgatgtaattgatctgaaaggagatcctcctgccctgtccggaattcctcggtatcgttatctacctc

SEQ ID NO: 737077 - DNA, 4582 bp, Homo sapiens
tagatgacaaatagtttttatttacttttgctctaagtagttcttctaactttgaataaaatgtctcttacatcatgaactaaatgaaatttgacatgccaaggctattccaggaggctgaaagtttggaggcagtaattctctactggggctgtctgccttaggacaaaattcactttattttgctttaggcccagttctaaggtttcccactagaaacaaattgctttttataccacagttcttatacaattatacatttggtagaatttataaggtgacaattgccaagaaatacagcctgaacacaggtgcagagtagagagagactgaaattcttcttggacccagcacttgagcagggataatttatgagtagttctgtttgccacactaaagcaacaccacccccagaatttcacaactcttgtttctcctcagttggcaaatgttgtttttggtttgctagttctgttttataaagatgtaaaagacttgcagtctttcatttaaaagacatccaactgagagagcgcgagtggaaatcatcgtgaatataattacaatgtgggcagtaataagcatttatactgcaagtttaatcatttacagctgacacatttaagagcccatttagttaccttgaacaaaagcaacagtgtggcatagtggttctcaatcctggctgactttagaatcacctggggagctttaaaaaggaaaaaaagagttcatgggcacagctcctggagactttgatttattctgtctgaggcagggctcaggcctctgtgtttaaacgccccagatgattctaatttgtagtcagacttgagaatgaccggtaaagcagaaggagcatgcgtttagagtgaaacgttggctcttctcttagggatcggcagagacttcactctcacaggctggcacggtgactgctctctctggttccaaaagcaaggtcagcctcatgaggcacctgcaacctcggcttttcttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcagagagggcttctcactctattgcccaggctgatgtgcagtagccattcactggtgagatcatcacgcgctacagcatcaaactcctggcctcaagtgatccccctgcctcagcctccgaagtagctgggattacaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtgagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 737078 - DNA, 4323 bp, Homo sapiens
tagatgacaaatagtttttatttacttttgctctaagtagttcttctaactttgaataaaatgtctcttacatcatgaactaaatgaaatttgacatgccaaggctattccaggaggctgaaagtttggaggcagtaattctctactggggctgtctgccttaggacaaaattcactttattttgctttaggcccagttctaaggtttcccactagaaacaaattgctttttataccacagttcttatacaattatacatttggtagaatttataaggtgacaattgccaagaaatacagcctgaacacaggtgcagagtagagagagactgaaattcttcttggacccagcacttgagcagggataatttatgagtagttctgtttgccacactaaagcaacaccacccccagaatttcacaactcttgtttctcctcagttggcaaatgttgtttttggtttgctagttctgttttataaagatgtaaaagacttgcagtctttcatttaaaagacatccaactgagagagcgcgagtggaaatcatcgtgaatataattacaatgtgggcagtaataagcatttatactgcaagtttaatcatttacagctgacacatttaagagcccatttagttaccttgaacaaaagcaacagtgtggcatagtggttctcaatcctggctgactttagaatcacctggggagctttaaaaaggaaaaaaagagttcatgggcacagctcctggagactttgatttattctgtctgaggcagggctcaggcctctgtgtttaaacgccccagatgattctaatttgtagtcagacttgagaatgaccggtaaagcagaaggagcatgcgtttagagtgaaacgttggctcttctcttagggatcggcagagacttcactctcacaggctggcacggtgactgctctctctggttccaaaagcaaggtcagcctcatgaggcacctgcaacctcggcttttcttggagtttcttccaaaatttcctggaacttggttctctcatattccaccaactggcgttgaaggtgcggtctgagactcataattgtaaaattggccatgtccatttgcatgaggtccaggacatggaatatttgtctcagcacctccacgatgttgccagtagcctttaactctctgatatcattatctcgcacgggagcacacagctttcccatcgtactgatgacatagttggccaggccttggatgtcaacagcactgtgctcaggcctgctgcctaatgaggtctgtgtccaaaacttcacagatttggttgcgaagccggttgccaccgggagtgagaaaagagagaagaatctctctgatttcttcaaacagtttgatggcatgttcaaactcaggagggtcagcatttagttctgaatccaagacgtcccagaaggcctggtgaacaatgtgcttcactcgaccagccaaactcttttctgggagagcctcttgtttcaattgaaagttctcatttacagcaatctcatgagcaagagtcaagtttgataagttccttgctgtagccatcacttcatcaaatgttacaacccttggagggcttgttgaagcaggagagctggatttgctggaggagtcacttgtaaagctctgcctggagcattcatagtcactgagcgaagccatgctttcggaaaaccgggaagaatcagaatcgcttggctggtcctctcccacacactgcttctcgccattgaagggcattttgcgtcacttaagtgtgggtaaaaaggtagcacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcagagagggcttctcactctattgcccaggctgatgtgcagtagccattcactggtgagatcatcacgcgctacagcatcaaactcctggcctcaagtgatccccctgcctcagcctccgaagtagctgggattacaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 737079 - DNA, 753 bp, Homo sapiens
  misc_feature (737)..(737): n is a, c, g, or t
  misc_feature (739)..(741): n is a, c, g, or t
agcatgacttacagaagcctttaattataatttaccatttctggccaggcacagtagctcatgcctgtaacaccatcactttgggaggctgaggcgggatgattacttgagcccgggagttcaagaccagcctgggaaacagggagacccctgtctcttaaaaaaagaaaatcaaaaaatgagccaggcatggtggctcacacctgtggttctagctactgaggaggctgaggaaggaggatgatgagcctgcgcagtttaaactgcgccacttcactccagcctgggtgataagattatgtctcaaaacaaaacaaaaaggccacatcacattgtacactttaaatataaacaatttttgcttgtcaattataactcaataaagctggggcaggtaggggacacggcagtacagtaaaaatccctcacctatctgcttgcacaaatgcaagcagatttccatctgggcagcttttttcaaacttttggcagttgcatcctcacaactgccttattacttaattacataatatttaaccccttatgcttaaaaaaaaaacccacgaaactacagacttcatcagtctttgcactaatgtcctcttgttgaggaagaatctccttcagggtgggacgatgcacttagcagtcacatctctgtggccacaaaggctgcttctcatttataccgggagaaacgttgccagcacagctgctgtgcaggctcctcgtgccgnannngccacccaggcc

SEQ ID NO: 737080 - DNA, 20439 bp, Homo sapiens
  misc_feature (6)..(6): n is a, c, g, or t
  misc_feature (12)..(12): n is a, c, g, or t
  misc_feature (17)..(17): n is a, c, g, or t
  misc_feature (20)..(20): n is a, c, g, or t
  misc_feature (23)..(23): n is a, c, g, or t
  misc_feature (26)..(26): n is a, c, g, or t
  misc_feature (68)..(68): n is a, c, g, or t
  misc_feature (221)..(221): n is a, c, g, or t
  misc_feature (352)..(352): n is a, c, g, or t
  misc_feature (1501)..(1501): n is a, c, g, or t
  misc_feature (1575)..(1575): n is a, c, g, or t
  misc_feature (2791)..(2792): n is a, c, g, or t
  misc_feature (3066)..(3066): n is a, c, g, or t
  misc_feature (3101)..(3101): n is a, c, g, or t
  misc_feature (3169)..(3169): n is a, c, g, or t
  misc_feature (3211)..(3211): n is a, c, g, or t
  misc_feature (3655)..(3655): n is a, c, g, or t
  misc_feature (4593)..(4593): n is a, c, g, or t
  misc_feature (5613)..(5613): n is a, c, g, or t
  misc_feature (13212)..(13212): n is a, c, g, or t
  misc_feature (13418)..(13418): n is a, c, g, or t
  misc_feature (13537)..(13537): n is a, c, g, or t
  misc_feature (13615)..(13615): n is a, c, g, or t
  misc_feature (13671)..(13671): n is a, c, g, or t
  misc_feature (14945)..(14945): n is a, c, g, or t
tgcctnccagcngcccncanccngcngctgcccagagcccccatagagagaggtccccgccgccaccntcatggatcagccacagttcagcggggcgccccgctttctcacccggcccaaggccttcgtggtgtcggtgggcaaggacgccaccctcagctgccagatcgtgggtaatcccacgccacaggtgagctgggagaaggaccagcagccggtgncggccggcgcgcgcttccgtctggcccaggacggcgacctctaccgcctcactatcctggacctggcgctgggcgacagtgggcaatacgtgtgccgcgcgcgcaatgccataggcgaggccttcgctgcngtgggcctgcaggtggacgcggaggccgcgtgcgccgagcaggcgccgcacttcctgctgcggcccacgtccatccgcgtgcgcgagggctcagaggccaccttccgctgccgcgtgggtggctccccgaggccggcagtgagctggtccaaggacgggcggcgcctgggtgagcccgacggcccccgcgtgcgcgtggaggagctcggcgaggcaagtgcgctgcgcattcgggcggcgcggccgcgcgacggcggcacttacgaggtccgcgccgagaacccgctgggcgctgccagcgccgccgcggcgctagtggtggactcggacgccgcggacacggccagccggcccgggacctccacggccgcgctcctggcgcacctgcagcggcggcgcgaggctatgcgcgccgagggcgcccccgcctcaccgcccagcaccggcacgcgcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcgagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactnaccatctcccagtgctgcctggaggatgtgggccaggtggcctttatggctggcgactgccagacgtccacccngttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagnnccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccantgccacgctgagctgcgaggtggcccaggcccagncggaggtgatgtggtacaaagatgggaagaagctgagctccagcttgaaagtgcatgtagaggccaanggctgcagacggaggctggtggtgcagcaggcaggcaagacngatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacngaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggncgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcggatgctggggagtacagctgtgaggcggggggccaacggctgtccttccgcctgcacgtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcntcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacggctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccccacagccagtgttccgggagccgctgcagagtctgcaggcggaggagggctccacggccaccctgcagtgtgagctgtctgagcccactgctacagtggtctggagcaagggtggcctgcagctgcaggccaatgggcgccgggagccacggcttcagggctgcaccgcggagctggtgttacaggacctacaacgtgaagacactggcgaatacacttgcacctgtggctcccaggccaccagtgccaccctcactgtcacagctgcgcctgtgcggttcctccgagagctgcagcaccaggaggtggatgagggaggcaccgcacacttatgctgcgagctgagccgggcgggtgcgagcgtggagtggcgcaagggctccctacagctcttcccttgtgccaagtaccagatggtgcaggatggtgcagctgcagagctgctggtacgcggagtggagcaggaggatgcgggtgactacacgtgtgacacgggccacacgcagagcatggccagcctctctgtccgtgtccccaggcccaagttcaagacccggcttcagagtctggagcaggagacaggtgacatagcccggctgtgctgtcagctgagtgatgcagagtcgggggccgtggtgcaatggctcaaggagggcgtggagctgcatgcgggccccaagtacgagatgcggagccagggggccacgcgggagctgctgatccaccaactggaggccaaggacacgggcgagtatgcctgtgtgacaggcggccagaaaaccgctgcctccctcagggtcacagagcctgaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgaggacgctggcactgtctccttccatttgggaaaccatgcttcctctgcccagctcaccgtcagagctcctgaggtgaccatcctggagcccctgcaggacgtgcagctcagtgagggccaggatgccagcttccagtgccggctatccagagcttcaggccaggaggcccgctgggctttaggaggggtgcccctgcaggccaacgagatgaatgacatcactgtggagcagggcacactccacctgctcaccctgcacaaggtgacccttgaggatgctggaactgtcagtttccacgtgggcacgtgtagctctgaggcccagctgaaagtcacagccaagaacacggtggtgcgggggctggagaatgtggaggcgctggagggcggcgaggcgctgttcgagtgccagctgtcccagcccgaggtggccgcccacacctggctgctggacgacgaacccgtgcncacctcggagaacgccgaggtggtcttcttcgagaacggcctgcgccacctgctgctgctcaaaaacttgcggccacaagacagctgccgggtgaccttcctggctggggatatggtgacgtccgcattcctcacggtccgaggctggcgcctggagatcctggagcctctgaaaaacgcggcggtccgggccggcgcacaggcangcttcacctgcacgctcagcgaggcggtgcccgtgggagaggcgtcctggtacatcaatggcgcggcagtgcagccggatgacagcgactggactgtcaccgccgacggcagtcaccangccctactgctgcgcagcgcccagccccaccacgccggggaggtcaccttcgcttgccgcgacgccgtggcctctgcncggctcaccgtgctgggcctccctgatcccccagaggatgctgaggtggtggctcncagcagccacactgtgacactgtcttgggcagctcccatgagtgatggaggcggtggtctctgtggctaccgcgtggaggtgaaggagggggccacaggccagtggcggctgtgccacgagctggtgcctggacccgagtgtgtggtggatggcctggcccccggggagacctaccgcttccgtgtggcagctgtgggccctgtgggtgctggggaaccggttcacctgccccagacagtgcggcttgcagagccaccgaagcctgtgcctccccagccctcagcccctgagagccggcaggtggcagctggtgaagatgtctctctggagcttgaggtggtggctgaggctggtgaggtcatctggcacaagggaatggagcgcatccagcccggtgggcggttcgaggtggtctcccagggtcggcaacagatgctggtgatcaagggcttcacggcagaagaccagggcgagtaccactgtggcctggctcagggctccatctgccctgcggctgccaccttccaggtggcactgagcccagcctctgtggatgaggcccctcagcccagcttgccccccgaggcagcccaggagggtgacctgcacctactgtgggaggccctggctcggaaacgtcgcatgagccgtgagcccacgctggactccattagcgagctgccagaggaggacggccgctcgcagcgcctgccacaggaggcagaggaggtggcacctgatctctctgaaggctactccacggccgatgagctggcccgcactggagatgctgacctctcacacaccagctctgatgatgagtcccgggcaggcaccccttccctggtcacctacctcaagaaggctgggaggccaggcacctcaccactggccagcaaggttggggccccagcagccccctctgtgaagccacagcagcagcaggagccactggctgctgtgcgcccaccactgggagacctgagcaccaaagacctgggtgatccctcaatggacaaggcagctgtgaagatccaggctgcctttaagggctacaaggtccggaaggagatgaagcagcaggaagggcccatgttctcccacacatttggggacaccgaggcacaggtgggggatgccctgcggctggagtgtgtcgtggccagcaaggcagatgtgcgagcccgctggctgaaggatggtgtggagctgaccgatgggcggcaccatcacatcgaccagcttggggatggcacctgctctctgctgatcnctggcctggaccgtgctgatgctggctgctacacctgtcaggtgagcaacaagtttggccaggtgacccacagtgcctgtgtggtggtcagtgggtcagagagtgaagccgagagctcctctgggggtgagctggacgatgccttccgccgggctgcccgtcggctgcaccggctcttccgcaccaaaagtccggctgaagtttcagatgaggagctcttcctgagtgcagacgagggccctgcagagccagaggagcccgcggactggcagacataccgcgaagatgagcatttcatctgcatccgttttgaggcgctcactgaggcccgccaggcggtaactcgcttccaggagatgtttgccacactgggcattggggtggagatcaagctggtggaacaggggcctcggagggtagagatgtgcatcagcaaagagactcctgcccctgtggtgcctccagagccattgcccagcctactgacttctgacgctgccccagtgttcctgactgagttgcagaaccaagaagtgcaggatgggtatcctgtgagctttgactgcgtggtgacaggtcagcccatgcccagtgtgcgctggttcaaggatgggaagttgttggaggaggatgatcactacatgattaatgaagaccaacagggtggccatcagctcatcatcacagccgtggtgccagcagacatgggcgtctaccgctgcctggccgagaacagcatgggtgtctcctccaccaaggctgagctccgtgtggacttgacaagcacagactatgacactgcagcagatgccacggagtcctcatcctacttcagtgcccaaggctacctgtccagccgggagcaggagggaacagagtccaccactgatgagggccagctgccccaggtggtggaggagctgagagacctccaggtggcccctggcacacgcctggccaagttccagctcaaggtgaaaggctaccctgctcccagattatactggttcaaagatggccagcccctgaccgcatctgcccacatccgcatgactgacaagaagatcctgcacaccctggagatcatctccgtcacccgggaggactctggccagtatgcagcctatatcagcaatgccatgggtgctgcctactcgtctgcccggctgctggttcgaggccctgatgagccagaagagaagcctgcatcagatgtgcatgagcagctggtgccgccccgaatgctggagaggttcacccccaagaaagtgaagaaaggctccagcatcaccttctctgtgaaggtagaaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggcctgcctaaggtggaggagcaggagaaagtgaaggaagcgctgatttccactttcctgcaggggaccacacaagccatctcagcacaggggttggaaactgcgagttttgctgaccttggtgggcagaggaaagaagagcctctggctgccaaggaggccctcggccacctgtccctcgctgaggtgggcacagaggagttcctgcagaaactgacctcccagatcactgagatggtatcggccaagatcacgcaggccaagctgcaggtgcccggaggtgacagtgatgaggactccaagacaccatctgcatccccccgccatggccgatcacggccatcctccagcatccaggagtcttcctcagagtcagaggacggcgatgcccgaggcgagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaagctgtcacctgagtggggggccgctgaggcccctgagttccctggggaggctgtgtctgaagacgaatacaaggcaaggctgagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaagaaatacgcggaggaggccctgttggcaggggacccctctcagcccccgccaccacctctgcagcactacctggagcagccagtggagcgggtgcagcgctaccaggccttgctgaaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctgcaggccctgggcgagcccatccgccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcggcccccggactttgaagaggagctggccgactgcacagccgagctgggtgagacagtcaagctggcctgccgcgtgacgggcacacccaagcctgtcatcagctggtacaaagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacgagtgtgagctggtgaaccggctgggctccgcgcgggctagtgcggagctgcgcattcagagccccatgctgcaggcccaggagcagtgtcacagggagcagctcgtggctgcagtggaagtcactgagcaagagactaaagtccccaagaaaaccgtcatcatagaagagaccatcaccactgtggtgaagagcccacgtggccaacgacggtcccccagcaagtccccctcccgctcaccttcccgctgctctgccagcccgctgaggccaggcctactggcccccgacctgctgtacctgccaggtgctggccagccccgcaggccggaggcagaaccaggccagaagcccgtggtgcccacactgtatgtgacggaggccgaggcccactctccagctctgcccggactctcggggccccagcccaagtgggtggaggtggaggagaccattgaagtccgggtgaagaagatgggcccgcagggtgtgtctcccaccacagaggtgcccaggagctcatcggggcatctcttcacactgcccggtgcgacccccggaggggaccccaattccaacaactccaacaacaagctgctggcccaggaggcctgggcccagggcacagccatggtcggcgtcagagagccccttgtcttccgcgtggatgccagaggcagtgtggactgggctgcttctggcatgggcagcctggaggaggagggcaccatggaggaggcgggagaggaagagggggaagacggagacgcctttgtgacggaggagtcccaggacacacacagccttggggatcgtgaccccaagatcctcacgcacaacggccgcatgctgacactggctgacctggaagattacgtgcctggggaaggggagaccttccactgtggtggccctgggcctggcgcccctgatgaccctccctgcgaggtctcggtgatccagagagagatcggggagcccacggtggggcagcctgtgctgctcagcgtggggcatgcactgggtccccgaggccctctcggcctctttaggcctgagccccgtggggcgtcaccaccgggaccccaggtccgtagccttgagggcacctccttcctcttgcgggaggccccggctcggcctgtgggcagtgctccctggacgcagtctttctgcacccgcatccggcgttctgcggacagtggccagagcagcttcaccacagagctttccacccagaccgtcaacttcgggacagtgggggagacggtcacccttcacatctgcccagacagggatggggatgaggcggcacagccctgatgctgctgccatggtggcttggggcagcggggagaaaggagtgtccttgaggcctaggacgctgcccggcctcagcagcagccctgggagcctcctgagggccctccctgtccctggccacgggcccttcttacctcactcaacttcagccaggaggactgggtggtgcttgcaatgttggaatgaccggctcaaagacctcagctctgggctgtttcctgtcagcctggcaggagcctcaggactgtggacgaaggatgtggccttgggcatttgtcctgttcccacatgggcctggtccctccctcctggccccagccacagctgccaggcctgacatggccttgcctctcctgcagtcttggtgactgagacccttgggtggcgcttcccagctctgcaggccctcctggccttttctgcagggtggacacagggtctgtgtgtgggcagcagcccctgtctctcagcaagaataaagcagcttcctgtgcaaaaaactgatt

SEQ ID NO: 737081 - DNA, 403 bp, Homo sapiens; identical to SEQ ID NO: 381798

SEQ ID NO: 737082 - DNA, 2882 bp, Homo sapiens
ttctttgattgtttaaccttacaaaaatttagactagtaacttatttcacactgaaaagtgagttccaggaaggttagaggccacagagtataaaaggtaaaaccataaagcctctagatgctaacatagattgctaaaaacttcagggaacggaaagatttcttaaaactaaacagtggaacaatggtatatttaactacattaaaactaaaactttaatttgtcaagacatcatttgagagcgaaaaggccggtcaaggacatgggtaagatgtttacaaatacacagttatcatttgctagcatttaaaatatataaagagttcctaaaaataaggaaggaaaagacagaaaaggctactgaaaattggacagaagcctgaagagcgacaccccagaagagctgacgtaatggccagaagtggtggaaagggctccaccttgcatgtcaccaggcaatgcatgacaaagcccaggccttccccgcagaggccaacgctgaccctcctgacagtggcaggactggaagcctcagtactctggggccctgcagtgaggacacgccctgcccagtcccatggggagaccctagcatatccttgaagggagctgtgtaagcattaggaacccagtccctgcactggaggagctcgtgcacggagggtttgtcacaactgccccgcctggaatagcccatggcactgcacagtggatggagaaactgtgattcttgtgctgggaggtggtggggcttctcccagctacatggccagtgccaagcttgggaaggttctgtttctcctactttctcgtctaggccctcctaccctagggtggtcttcctgacctgggcagtatctttgacctcgtgtgtccctccttgtccatccccagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcaggtcagtgctttggggatgctgagtgagccctgtttgtagctgctgctgtgactggagtagaaccactgctgacccagtgggctttccattagactccatccctcaacttctcccatcctctcacctcctatttttatgcctgtggtggagctgggctgcttagtggggaagggagtgaacggaagggtcagggccctccttgtccatgttgggtggtgtttctgtgcagacatgctgggtcacattttcccagtaccttctccaaactaccgatgtcccgaggtgtccaggactctggtcctatctaatgcatgagatggcggtaagccagacgtccctccctcggggatactcctgcagtccctgcacggcctcatctggccccatgtgagggctctccctgtggaaagagattttaattcgttgagtcagggtgtagggaaattccagccacacagtcttatttggaattatatcaacactgaacactgggttcccaaagttttcagtgttctgggacacacttctgtccttccctgtggatgtagaagccctgtcagagccctgactaaaacccagatccacagcgttagtgtgtgcaaaacgagtaaagagcagcacattggcaggtgcgcacacgtgacgttggaattccatttcggaagccaatctcactttccttttgcattctgttagaatgttctgtgtctgaattccccttggaatttggatagatttaaaagtgataggaataagtagctggtgtttctagcctccgcctccaggcgggtgaggaggtgacacctgagaattcctccctctcacccctgaccctgccggaaagcgaaactgagatgcgggcattgggccctgggaagcgtggggaaggggaaaggagaaagccaggtgggtttttaggtcccttccagtgccacactgtggggtgttgaggggccgcgcgaggcaggcccttccatgaggcctggactggaggccttctctaggcgccggcgctggcctgggccgcctgccgccacgcaggggccgcacgcctgggccccagggcccctttgccggcgggaggccggggggaccgactgctcttggcgcccggggtcaggggaggccgggaaacctcggctcccgggcgacaggcacccaggcccttctcagccccccggccgcggccgcgccgggcctcgcttcagccgggcgattcttcccctcatttgttgcattgtttgcattaatatgaatatcttgttctgtttgttttgtctcctgagagccaataaagctgtgttttttctttacaccaaaaaaaaaaaaaaaaaaaaaaaggaataagtagcttatggcacagtgacacactggtagaattaagttatggtggtagcagtcgctgactggggaagccatatttacatcatcctgtttccttgatgagtcctgtgcctgccccctctccagctgattcataggaagtctgagaatgacctttactttcctattgtttgttaggagagtttaacttcaaactccaaccctgagccctgagtgccaccacataacagttggtgttatatatatctaaaatggtttacaaatgtgtagataccaaaaatactcactgcaagtaaatttgaaaagtgttaacaaattatataatttctagaaaccaaaaacagacttaagaaatagataacctata

SEQ ID NO: 737083 - DNA, 638 bp, Homo sapiens
ttcccccctctgcagttcctgccagtgctactagtggggatcacgtctaggatttcgaggcacaagggcctggcgtcttgttcagagcaggggagctggaggtgggagcggggcttaaggaagcttcctggtttcctcgcttaaagtcgcacccgggagggtgcgcagctgcggcccgcgtgtggccagggccgcgctgtttggattgggatcccggggcgcggtgccggcagctctgcctgggcccggctcagggcaggcgccggggctgtgcgggccctctgtaccttggcttgtccgtggaggagggcgagggccgccgtgacctcccctctcctgcgaccccagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagagtgagccgcgggcgggaagggcg

SEQ ID NO: 737084 - DNA, 1859 bp, Homo sapiens; identical to SEQ ID NO: 381801

SEQ ID NO: 737085 - DNA, 1836 bp, Homo sapiens
atgtgggtggctcttggggtggctcatcgcgtggctcattatgcatgtgtaagagttctttgtgcactctcactgctggcttgctggtacaataacctgagctctcacgctgccctggcaatcctgggcgctgtgcccatcttttctcgggccctctcctccctcccccagagaagagaccatcaccactgtggtgaagagcccacgtggccaacgacggtcccccagcaagtccccctcccgctcaccttcccgctgctctgccagcccgctgaggccaggcctactggcccccgacctgctgtacctgccaggtgctggccagccccgcaggccggaggcagaaccaggccagaagcccgtggtgcccacactgtatgtgacggaggccgaggcccactctccagctctgcccggactctcggggccccagcccaagtgggtggaggtggaggagaccattgaagtccgggtgaagaagatgggcccgcagggtgtgtctcccaccacagaggtgcccaggagctcatcggggcatctcttcacactgcccggtgcgacccccggaggggaccccaattccaacaactccaacaacaagctgctggcccaggaggcctgggcccagggcacagccatggtcggcgtcagagagccccttgtcttccgcgtggatgccagaggcagtgtggactgggctgcttctggcatgggcagcctggaggaggagggcaccatggaggaggcgggagaggaagagggggaagacggagacgcctttgtgacggaggagtcccaggacacacacagccttggggatcgtgaccccaagatcctcacgcacaacggccgcatgctgacactggctgacctggaagattacgtgcctggggaaggggagaccttccactgtggtggccctgggcctggcgcccctgatgaccctccctgcgaggtctcggtgatccagagagagatcggggagcccacggtggggcagcctgtgctgctcagcgtggggcatgcactgggtccccgaggccctctcggcctctttaggcctgagccccgtggggcgtcaccaccgggaccccaggtccgtagccttgagggcacctccttcctcttgcgggaggccccggctcggcctgtgggcagtgctccctggacgcagtctttctgcacccgcatccggcgttctgcggacagtggccagagcagcttcaccacagagctttccacccagaccgtcaacttcgggacagtgggggagacggtcacccttcacatctgcccagacagggatggggatgaggcggcacagccctgatgctgctgccatggtggcttggggcagcggggagaaaggagtgtccttgaggcctaggacgctgcccggcctcagcagcagccctgggagcctcctgagggccctccctgtccctggccacgggcccttcttacctcactcaacttcagccaggaggactgggtggtgcttgcaatgttggaatgaccggctcaaagacctcagctctgggctgtttcctgtcagcctggcaggagcctcaggactgtggacgaaggatgtggccttgggcatttgtcctgttcccacatgggcctggtccctccctcctggccccagccacagctgccaggcctgacatggccttgcctctcctgcagtcttggtgactgagacccttgggtggcgcttcccagctctgcaggccctcctggccttttctgcagggtggacacagggtctgtgtgtgggcagcagcccctgtctctcagcaagaataaagcagcttcctgtgcaaaaaactgatt

SEQ ID NO: 737086 - DNA, 1168 bp, Homo sapiens
gagagagagagagagagaactagttctgggctgcttctggcatgggcagcctggaggaggagggcaccatggaggaggcgggagaggaagagggggaagacggagacgcctttgtgacggaggagtcccaggacacacacagccttggggatcgtgaccccaagatcctcacgcacaacggccgcatgctgacactggctgacctggaagattacgtgcctggggaaggggagaccttccactgtggtggccctgggcctggcgcccctgatgaccctccctgcgaggtctcggtgatccagagagagatcggggagcccacggtggggcagcctgtgctgctcagcgtggggcatgcactgggtccccgaggccctctcggcctctttaggcctgagccccgtggggcgtcaccaccgggaccccaggtccgtagccttgagggcacctccttcctcttgcgggaggccccggctcggcctgtgggcagtgctccctggacgcagtctttctgcacccgcatccggcgttctgcggacagtggccagagcagcttcaccacagagctttccacccagaccgtcaacttcgggacagtgggggagacggtcacccttcacatctgcccagacagggatggggatgaggcggcacagccctgatgctgctgccatggtggcttggggcagcggggagaaaggagtgtccttgaggcctaggacgctgcccggcctcagcagcagccctgggagcctcctgagggccctccctgtccctggccacgggcccttcttacctcactcaacttcagccaggaggactgggtggtgcttgcaatgttggaatgaccggctcaaagacctcagctctgggctgtttcctgtcagcctggcaggagcctcaggactgtggacgaaggatgtggccttgggcatttgtcctgttcccacatgggcctggtccctccctcctggccccagccacagctgccaggcctgacatggccttgcctctcctgcagtcttggtgactgagacccttgggtggcgcttcccagctctgcaggccctcctggccttttctgcagggtggacacagggtctgtgtgtgggcagcagcccctgtctctcagcaagaataaagcagcttcctgtgcaaaaaactgatt

SEQ ID NO: 737087 - DNA, 12811 bp, Homo sapiens
  misc_feature (1121)..(1121): n is a, c, g, or t
  misc_feature (1195)..(1195): n is a, c, g, or t
  misc_feature (2411)..(2412): n is a, c, g, or t
  misc_feature (2686)..(2686): n is a, c, g, or t
  misc_feature (2721)..(2721): n is a, c, g, or t
  misc_feature (2789)..(2789): n is a, c, g, or t
  misc_feature (2831)..(2831): n is a, c, g, or t
  misc_feature (3275)..(3275): n is a, c, g, or t
  misc_feature (4213)..(4213): n is a, c, g, or t
  misc_feature (5233)..(5233): n is a, c, g, or t
  misc_feature (12729)..(12729): n is a, c, g, or t
  misc_feature (12740)..(12740): n is a, c, g, or t
  misc_feature (12747)..(12747): n is a, c, g, or t
  misc_feature (12749)..(12749): n is a, c, g, or t
  misc_feature (12755)..(12755): n is a, c, g, or t
  misc_feature (12763)..(12763): n is a, c, g, or t
  misc_feature (12765)..(12765): n is a, c, g, or t
  misc_feature (12770)..(12770): n is a, c, g, or t
  misc_feature (12776)..(12776): n is a, c, g, or t
  misc_feature (12781)..(12781): n is a, c, g, or t
  misc_feature (12792)..(12793): n is a, c, g, or t
  misc_feature (12795)..(12796): n is a, c, g, or t
  misc_feature (12798)..(12798): n is a, c, g, or t
  misc_feature (12802)..(12802): n is a, c, g, or t
  misc_feature (12809)..(12809): n is a, c, g, or t
tcacattgtacactttaaatatgtacaatttttatttgttatgcatcaataaagctgggattggggatgcgatggtataaaaactaactctcctctctacttgtgcaagtgcaagattctcatctggacagttgtcttcagacttttttgtgtcctcctcaagaatgtttagcctcttacagttaaaaaaaaaaaaaaaagctaaattcgagactatgtttgggtttcaccagttcttactcatgttgatttcacggaggtagagaactgaatgatggttaccagaggctggggagggaagcgggaagggagatgaagaggggctggttaatgggtagagacacacagtcagagaaaatgaatcagttctagtgtttagtagcatggtagagtgactgtaggtaacaataattcatcatatatagttgacccttgaacaacataggtttgcaccactgagtccacttatacgcagattttctggaaccaaatgggaagggaaccagcagtgttctcaggatgtcaaacctgtgtgtatagggagggccggcttgtcctatgcttgggttccacagggctgaccgtagaacttgagtatgcacagattttggtatatgcgggggtccaggaaccagcttcccatgtatgcttcaaaatagcagtcttctctcctggcagagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactnaccatctcccagtgctgcctggaggatgtgggccaggtggcctttatggctggcgactgccagacgtccacccngttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagnnccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccantgccacgctgagctgcgaggtggcccaggcccagncggaggtgatgtggtacaaagatgggaagaagctgagctccagcttgaaagtgcatgtagaggccaanggctgcagacggaggctggtggtgcagcaggcaggcaagacngatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacngaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggncgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcggatgctggggagtacagctgtgaggcggggggccaacggctgtccttccgcctgcacgtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcntcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggccgcaacatccagatcgtgaggcccctggaggatgtggaagtgatggagaaggacggtgccaccttctcctgtgaggtctcccacgacgaagtgcctggccagtggttctgggagggcagtaaactgcggcccactgacaacgtgcgcatccgccaggaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacggctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcagggccctgcctgccaggttcacagagggtctgaggaatgaagaggccatggaaggggccacagccacactgcaatgtgagctgagcaaggcagcccctgtggagtggaggaaaggccttgaggctctcagagatggggacaaatacagcctgagacaagacggggctgtgtgtgagctgcagattcatggcctggctatggcagataacggggtgtactcatgtgtgtgtgggcaggagaggacctcagctacactcactgtcagggccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcagggccctgccggccagattcatagaagatgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcagggccctgccagccagattcatagacaacatgacaaaccaggaagccagagaaggggccacggccacactgcactgtgaactgagcaaggtggcccctgtggagtggaggaagggacctgaaaccctccgagatggggacagacacagcctgaggcaggagaatngcttgaacccnggaggcngnggttgnagtgagcnangatcntgccantgcantccagcctggnnannanagcnagctctntc

SEQ ID NO: 737088 - DNA, 3941 bp, Homo sapiens
  misc_feature (1026)..(1026): n is a, c, g, or t
  misc_feature (1759)..(1759): n is a, c, g, or t
  misc_feature (3108)..(3108): n is a, c, g, or t
  misc_feature (3182)..(3182): n is a, c, g, or t
agcatgacttacagaagcctttaattataatttaccatttctggccaggcacagtagctcatgcctgtaacaccatcactttgggaggctgaggcgggatgattacttgagcccgggagttcaagaccagcctgggaaacagggagacccctgtctcttaaaaaaagaaaatcaaaaaatgagccaggcatggtggctcacacctgtggttctagctactgaggaggctgaggaaggaggatgatgagcctgcgcagtttaaactgcgccacttcactccagcctgggtgataagattatgtctcaaaacaaaacaaaaaggccacatcacattgtacactttaaatataaacaatttttgcttgtcaattataactcaataaagctggggcaggtaggggacacggcagtacagtaaaaatccctcacctatctgcttgcacaaatgcaagcagatttccatctgggcagcttttttcaaacttttggcagttgcatcctcacaactgccttattacttaattacataatatttaaccccttatgcttaaaaaaaaaacccacgaaactacagacttcatcagtctttgcactaatgtcctcttgttgaggaagaatctccttcagggtgggacgatgcacttagcagtcacatctctgtggccacaaaggctgcttctcatttataccgggagaaacgttgccagcacagctgctgtgcaggcttaagcaaattgttttcaccctgtgagcctcaggcctctcttctataagatgagaaaacacccttgtttgggaatatctaataagatactgacatgaaaaggccttatgaacgcaaaagcgtgacacacctgtgtgttctctcggtgctgctgggatgtgcgtttgctgaatgtgtgtcatctacaagctggtcaaggatggaaaatgccttccctcctaacattcagaagggaatgaaaaccctctttcctcctggaatacagaggaggaaagaacttcatctttacacccaagccaagncaccagagattcttgacatgttcagatacgacttggggatcataaaatgttcaggaaaccctgcaggactgacttacagttttttttgcctatagtttgtgggcacccggggcccagccaccccatcgcctgggcagcaggtgcaggtctgaggcctccgggcccaccatcccccaggccttgggagatggctgtgagaacacccccttcagttaaactgcacccaggatgccagcccacccagctgtgaaagcccctgggaggagggctcatggcgggacatccctgtggaagctggcaactcaagggacacagtgacatttgctttcctcaggaaattgtgtctgctcctcctccacctgtacccctttgaacagacagcagctccatgaaagttctctttgcagtggattccagccaggaataggcaaggtccatggccagccactgcatcctgtggcctcccgtggtgtgaaggacaccctgggcacagtgcctccggaagctctgtagtgtgaatatcccactgtcttcaacaaatacgttgcagggaaataaggaacaacaggggtcctgtgaaggaggcagaaaatccagcctgaaggctggcagtggtgtttggagatgcagcggagcaggcagcagtgaagagggtcaggagggcaggccactcctggaggctgtgggggcattgcttctcccaggtccaggaggccctgcaaggggctggccngcacagccatcttctctgcaccctccacggccctgtccgggagggggtggggcacgtattcgagcacacacaatgcacacacacttctgcatggctggggcagctcagggccaagctcctggtgggggagtgggctctccttccagcctttcctttctccctggtgctgtggactgaatgtgtgtcccggagattcacacgttgaaatgctcacccccaaggtgacaggattagaacgtgagcttttggaagtgatcagtcatgagataaggctgcagaatggcataaccgttactccagagacccctcaccctccttctgattgaggacacatgagagatgttggccattgcccggaagagcctgaggtacgctgtgaggacacatagaggcctggcactggatcagggatggggcgaagcagctcactgcagctttgacctcctgggctcaagccatcctcctgcttcagtctcttgagtagctgggacagcaggcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcggtgagctcctgggtgcggggcgcgcgggcccaggctcctccgcaacccgtgcacctgggtcctttcgcccttgcggtctgccgtttcccacccgcgtctgtccggtcgtggaatccagggttgcaggtgtccgttccagtcttctctcctggcagagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactnaccatctcccagtgctgcctggaggatgtgggccaggtggcctttatggctggcgactgccagacgtccacccngttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctgggtaagtgggacctccctgttacaacctacggggctgctcacctgccccggaatcccccaggtccagcttcaggggaggccagagtggcctcatggggaccttctgtggggaggggggctgccaaggccttgccctggtgcagtgtccgtggtggaaggataggtgaccccactacagggcccctgggagcctgcctgtctccagcagacccaggggacggggctccagggctgccccactctggtggggcttgtaggatgctggaggggtctcagggcagctgtaccttgtccttgttccttcatgagcctgactcatgctatggtcgctctgtgtgttggctgggcttcctggaggaggaacatttaggtctaggctctgtaggaagagaaggggaaggcagagacctcctcagcactccccactcctcctcggc

SEQ ID NO: 737089 - DNA, 13600 bp, Homo sapiens
  misc_feature (1026)..(1026): n is a, c, g, or t
  misc_feature (1759)..(1759): n is a, c, g, or t
  misc_feature (3108)..(3108): n is a, c, g, or t
  misc_feature (3182)..(3182): n is a, c, g, or t
  misc_feature (4398)..(4399): n is a, c, g, or t
  misc_feature (4673)..(4673): n is a, c, g, or t
  misc_feature (4708)..(4708): n is a, c, g, or t
  misc_feature (4776)..(4776): n is a, c, g, or t
  misc_feature (4818)..(4818): n is a, c, g, or t
  misc_feature (5262)..(5262): n is a, c, g, or t
  misc_feature (6200)..(6200): n is a, c, g, or t
  misc_feature (7220)..(7220): n is a, c, g, or t
agcatgacttacagaagcctttaattataatttaccatttctggccaggcacagtagctcatgcctgtaacaccatcactttgggaggctgaggcgggatgattacttgagcccgggagttcaagaccagcctgggaaacagggagacccctgtctcttaaaaaaagaaaatcaaaaaatgagccaggcatggtggctcacacctgtggttctagctactgaggaggctgaggaaggaggatgatgagcctgcgcagtttaaactgcgccacttcactccagcctgggtgataagattatgtctcaaaacaaaacaaaaaggccacatcacattgtacactttaaatataaacaatttttgcttgtcaattataactcaataaagctggggcaggtaggggacacggcagtacagtaaaaatccctcacctatctgcttgcacaaatgcaagcagatttccatctgggcagcttttttcaaacttttggcagttgcatcctcacaactgccttattacttaattacataatatttaaccccttatgcttaaaaaaaaaacccacgaaactacagacttcatcagtctttgcactaatgtcctcttgttgaggaagaatctccttcagggtgggacgatgcacttagcagtcacatctctgtggccacaaaggctgcttctcatttataccgggagaaacgttgccagcacagctgctgtgcaggcttaagcaaattgttttcaccctgtgagcctcaggcctctcttctataagatgagaaaacacccttgtttgggaatatctaataagatactgacatgaaaaggccttatgaacgcaaaagcgtgacacacctgtgtgttctctcggtgctgctgggatgtgcgtttgctgaatgtgtgtcatctacaagctggtcaaggatggaaaatgccttccctcctaacattcagaagggaatgaaaaccctctttcctcctggaatacagaggaggaaagaacttcatctttacacccaagccaagncaccagagattcttgacatgttcagatacgacttggggatcataaaatgttcaggaaaccctgcaggactgacttacagttttttttgcctatagtttgtgggcacccggggcccagccaccccatcgcctgggcagcaggtgcaggtctgaggcctccgggcccaccatcccccaggccttgggagatggctgtgagaacacccccttcagttaaactgcacccaggatgccagcccacccagctgtgaaagcccctgggaggagggctcatggcgggacatccctgtggaagctggcaactcaagggacacagtgacatttgctttcctcaggaaattgtgtctgctcctcctccacctgtacccctttgaacagacagcagctccatgaaagttctctttgcagtggattccagccaggaataggcaaggtccatggccagccactgcatcctgtggcctcccgtggtgtgaaggacaccctgggcacagtgcctccggaagctctgtagtgtgaatatcccactgtcttcaacaaatacgttgcagggaaataaggaacaacaggggtcctgtgaaggaggcagaaaatccagcctgaaggctggcagtggtgtttggagatgcagcggagcaggcagcagtgaagagggtcaggagggcaggccactcctggaggctgtgggggcattgcttctcccaggtccaggaggccctgcaaggggctggccngcacagccatcttctctgcaccctccacggccctgtccgggagggggtggggcacgtattcgagcacacacaatgcacacacacttctgcatggctggggcagctcagggccaagctcctggtgggggagtgggctctccttccagcctttcctttctccctggtgctgtggactgaatgtgtgtcccggagattcacacgttgaaatgctcacccccaaggtgacaggattagaacgtgagcttttggaagtgatcagtcatgagataaggctgcagaatggcataaccgttactccagagacccctcaccctccttctgattgaggacacatgagagatgttggccattgcccggaagagcctgaggtacgctgtgaggacacatagaggcctggcactggatcagggatggggcgaagcagctcactgcagctttgacctcctgggctcaagccatcctcctgcttcagtctcttgagtagctgggacagcaggcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcggtgagctcctgggtgcggggcgcgcgggcccaggctcctccgcaacccgtgcacctgggtcctttcgcccttgcggtctgccgtttcccacccgcgtctgtccggtcgtggaatccagggttgcaggtgtccgttccagtcttctctcctggcagagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactnaccatctcccagtgctgcctggaggatgtgggccaggtggcctttatggctggcgactgccagacgtccacccngttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagnnccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccantgccacgctgagctgcgaggtggcccaggcccagncggaggtgatgtggtacaaagatgggaagaagctgagctccagcttgaaagtgcatgtagaggccaanggctgcagacggaggctggtggtgcagcaggcaggcaagacngatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacngaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggncgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcggatgctggggagtacagctgtgaggcggggggccaacggctgtccttccgcctgcacgtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcntcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggccgcaacatccagatcgtgaggcccctggaggatgtggaagtgatggagaaggacggtgccaccttctcctgtgaggtctcccacgacgaagtgcctggccagtggttctgggagggcagtaaactgcggcccactgacaacgtgcgcatccgccaggaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacggctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcaggggtaaagaccacatgtggccacctgagtgattcctgtctcctcccacctaacccacatgatctgtgctctcccagttcctcttgatgtcattgccatctcatt

SEQ ID NO: 737090 - DNA, 13897 bp, Homo sapiens
  misc_feature (1026)..(1026): n is a, c, g, or t
  misc_feature (1759)..(1759): n is a, c, g, or t
  misc_feature (3108)..(3108): n is a, c, g, or t
  misc_feature (3182)..(3182): n is a, c, g, or t
  misc_feature (4398)..(4399): n is a, c, g, or t
  misc_feature (4673)..(4673): n is a, c, g, or t
  misc_feature (4708)..(4708): n is a, c, g, or t
  misc_feature (4776)..(4776): n is a, c, g, or t
  misc_feature (4818)..(4818): n is a, c, g, or t
  misc_feature (5262)..(5262): n is a, c, g, or t
  misc_feature (6200)..(6200): n is a, c, g, or t
  misc_feature (7220)..(7220): n is a, c, g, or t
agcatgacttacagaagcctttaattataatttaccatttctggccaggcacagtagctcatgcctgtaacaccatcactttgggaggctgaggcgggatgattacttgagcccgggagttcaagaccagcctgggaaacagggagacccctgtctcttaaaaaaagaaaatcaaaaaatgagccaggcatggtggctcacacctgtggttctagctactgaggaggctgaggaaggaggatgatgagcctgcgcagtttaaactgcgccacttcactccagcctgggtgataagattatgtctcaaaacaaaacaaaaaggccacatcacattgtacactttaaatataaacaatttttgcttgtcaattataactcaataaagctggggcaggtaggggacacggcagtacagtaaaaatccctcacctatctgcttgcacaaatgcaagcagatttccatctgggcagcttttttcaaacttttggcagttgcatcctcacaactgccttattacttaattacataatatttaaccccttatgcttaaaaaaaaaacccacgaaactacagacttcatcagtctttgcactaatgtcctcttgttgaggaagaatctccttcagggtgggacgatgcacttagcagtcacatctctgtggccacaaaggctgcttctcatttataccgggagaaacgttgccagcacagctgctgtgcaggcttaagcaaattgttttcaccctgtgagcctcaggcctctcttctataagatgagaaaacacccttgtttgggaatatctaataagatactgacatgaaaaggccttatgaacgcaaaagcgtgacacacctgtgtgttctctcggtgctgctgggatgtgcgtttgctgaatgtgtgtcatctacaagctggtcaaggatggaaaatgccttccctcctaacattcagaagggaatgaaaaccctctttcctcctggaatacagaggaggaaagaacttcatctttacacccaagccaagncaccagagattcttgacatgttcagatacgacttggggatcataaaatgttcaggaaaccctgcaggactgacttacagttttttttgcctatagtttgtgggcacccggggcccagccaccccatcgcctgggcagcaggtgcaggtctgaggcctccgggcccaccatcccccaggccttgggagatggctgtgagaacacccccttcagttaaactgcacccaggatgccagcccacccagctgtgaaagcccctgggaggagggctcatggcgggacatccctgtggaagctggcaactcaagggacacagtgacatttgctttcctcaggaaattgtgtctgctcctcctccacctgtacccctttgaacagacagcagctccatgaaagttctctttgcagtggattccagccaggaataggcaaggtccatggccagccactgcatcctgtggcctcccgtggtgtgaaggacaccctgggcacagtgcctccggaagctctgtagtgtgaatatcccactgtcttcaacaaatacgttgcagggaaataaggaacaacaggggtcctgtgaaggaggcagaaaatccagcctgaaggctggcagtggtgtttggagatgcagcggagcaggcagcagtgaagagggtcaggagggcaggccactcctggaggctgtgggggcattgcttctcccaggtccaggaggccctgcaaggggctggccngcacagccatcttctctgcaccctccacggccctgtccgggagggggtggggcacgtattcgagcacacacaatgcacacacacttctgcatggctggggcagctcagggccaagctcctggtgggggagtgggctctccttccagcctttcctttctccctggtgctgtggactgaatgtgtgtcccggagattcacacgttgaaatgctcacccccaaggtgacaggattagaacgtgagcttttggaagtgatcagtcatgagataaggctgcagaatggcataaccgttactccagagacccctcaccctccttctgattgaggacacatgagagatgttggccattgcccggaagagcctgaggtacgctgtgaggacacatagaggcctggcactggatcagggatggggcgaagcagctcactgcagctttgacctcctgggctcaagccatcctcctgcttcagtctcttgagtagctgggacagcaggcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcggtgagctcctgggtgcggggcgcgcgggcccaggctcctccgcaacccgtgcacctgggtcctttcgcccttgcggtctgccgtttcccacccgcgtctgtccggtcgtggaatccagggttgcaggtgtccgttccagtcttctctcctggcagagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactnaccatctcccagtgctgcctggaggatgtgggccaggtggcctttatggctggcgactgccagacgtccacccngttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagnnccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccantgccacgctgagctgcgaggtggcccaggcccagncggaggtgatgtggtacaaagatgggaagaagctgagctccagcttgaaagtgcatgtagaggccaanggctgcagacggaggctggtggtgcagcaggcaggcaagacngatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacngaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggncgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcggatgctggggagtacagctgtgaggcggggggccaacggctgtccttccgcctgcacgtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcntcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggccgcaacatccagatcgtgaggcccctggaggatgtggaagtgatggagaaggacggtgccaccttctcctgtgaggtctcccacgacgaagtgcctggccagtggttctgggagggcagtaaactgcggcccactgacaacgtgcgcatccgccaggaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacggctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcaggggtaaagtccatctgtccagatctgcgttctggtgtccagttgttcacttcttgccatcaatctctgctcattgcatggtctcccccagactgccacactcttcacgtcatgccacactatcccttccagcttcct

SEQ ID NO: 737091 - DNA, 14674 bp, Homo sapiens
  misc_feature (1026)..(1026): n is a, c, g, or t
  misc_feature (1759)..(1759): n is a, c, g, or t
  misc_feature (3108)..(3108): n is a, c, g, or t
  misc_feature (3182)..(3182): n is a, c, g, or t
  misc_feature (4398)..(4399): n is a, c, g, or t
  misc_feature (4673)..(4673): n is a, c, g, or t
  misc_feature (4708)..(4708): n is a, c, g, or t
  misc_feature (4776)..(4776): n is a, c, g, or t
  misc_feature (4818)..(4818): n is a, c, g, or t
  misc_feature (5262)..(5262): n is a, c, g, or t
  misc_feature (6200)..(6200): n is a, c, g, or t
  misc_feature (7220)..(7220): n is a, c, g, or t
agcatgacttacagaagcctttaattataatttaccatttctggccaggcacagtagctcatgcctgtaacaccatcactttgggaggctgaggcgggatgattacttgagcccgggagttcaagaccagcctgggaaacagggagacccctgtctcttaaaaaaagaaaatcaaaaaatgagccaggcatggtggctcacacctgtggttctagctactgaggaggctgaggaaggaggatgatgagcctgcgcagtttaaactgcgccacttcactccagcctgggtgataagattatgtctcaaaacaaaacaaaaaggccacatcacattgtacactttaaatataaacaatttttgcttgtcaattataactcaataaagctggggcaggtaggggacacggcagtacagtaaaaatccctcacctatctgcttgcacaaatgcaagcagatttccatctgggcagcttttttcaaacttttggcagttgcatcctcacaactgccttattacttaattacataatatttaaccccttatgcttaaaaaaaaaacccacgaaactacagacttcatcagtctttgcactaatgtcctcttgttgaggaagaatctccttcagggtgggacgatgcacttagcagtcacatctctgtggccacaaaggctgcttctcatttataccgggagaaacgttgccagcacagctgctgtgcaggcttaagcaaattgttttcaccctgtgagcctcaggcctctcttctataagatgagaaaacacccttgtttgggaatatctaataagatactgacatgaaaaggccttatgaacgcaaaagcgtgacacacctgtgtgttctctcggtgctgctgggatgtgcgtttgctgaatgtgtgtcatctacaagctggtcaaggatggaaaatgccttccctcctaacattcagaagggaatgaaaaccctctttcctcctggaatacagaggaggaaagaacttcatctttacacccaagccaagncaccagagattcttgacatgttcagatacgacttggggatcataaaatgttcaggaaaccctgcaggactgacttacagttttttttgcctatagtttgtgggcacccggggcccagccaccccatcgcctgggcagcaggtgcaggtctgaggcctccgggcccaccatcccccaggccttgggagatggctgtgagaacacccccttcagttaaactgcacccaggatgccagcccacccagctgtgaaagcccctgggaggagggctcatggcgggacatccctgtggaagctggcaactcaagggacacagtgacatttgctttcctcaggaaattgtgtctgctcctcctccacctgtacccctttgaacagacagcagctccatgaaagttctctttgcagtggattccagccaggaataggcaaggtccatggccagccactgcatcctgtggcctcccgtggtgtgaaggacaccctgggcacagtgcctccggaagctctgtagtgtgaatatcccactgtcttcaacaaatacgttgcagggaaataaggaacaacaggggtcctgtgaaggaggcagaaaatccagcctgaaggctggcagtggtgtttggagatgcagcggagcaggcagcagtgaagagggtcaggagggcaggccactcctggaggctgtgggggcattgcttctcccaggtccaggaggccctgcaaggggctggccngcacagccatcttctctgcaccctccacggccctgtccgggagggggtggggcacgtattcgagcacacacaatgcacacacacttctgcatggctggggcagctcagggccaagctcctggtgggggagtgggctctccttccagcctttcctttctccctggtgctgtggactgaatgtgtgtcccggagattcacacgttgaaatgctcacccccaaggtgacaggattagaacgtgagcttttggaagtgatcagtcatgagataaggctgcagaatggcataaccgttactccagagacccctcaccctccttctgattgaggacacatgagagatgttggccattgcccggaagagcctgaggtacgctgtgaggacacatagaggcctggcactggatcagggatggggcgaagcagctcactgcagctttgacctcctgggctcaagccatcctcctgcttcagtctcttgagtagctgggacagcaggcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcggtgagctcctgggtgcggggcgcgcgggcccaggctcctccgcaacccgtgcacctgggtcctttcgcccttgcggtctgccgtttcccacccgcgtctgtccggtcgtggaatccagggttgcaggtgtccgttccagtcttctctcctggcagagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactnaccatctcccagtgctgcctggaggatgtgggccaggtggcctttatggctggcgactgccagacgtccacccngttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagnnccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccantgccacgctgagctgcgaggtggcccaggcccagncggaggtgatgtggtacaaagatgggaagaagctgagctccagcttgaaagtgcatgtagaggccaanggctgcagacggaggctggtggtgcagcaggcaggcaagacngatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacngaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggncgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcggatgctggggagtacagctgtgaggcggggggccaacggctgtccttccgcctgcacgtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcntcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggccgcaacatccagatcgtgaggcccctggaggatgtggaagtgatggagaaggacggtgccaccttctcctgtgaggtctcccacgacgaagtgcctggccagtggttctgggagggcagtaaactgcggcccactgacaacgtgcgcatccgccaggaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacggctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcagggccctgcctgccaggttcacagagggtctgaggaatgaagaggccatggaaggggccacagccacactgcaatgtgagctgagcaaggcagcccctgtggagtggaggaaaggccttgaggctctcagagatggggacaaatacagcctgagacaagacggggctgtgtgtgagctgcagattcatggcctggctatggcagataacggggtgtactcatgtgtgtgtgggcaggagaggacctcagctacactcactgtcagggccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcagggccctgccggccagattcatagaagatgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcaggggtaaagatcctgtgtggtcacatggacttgtggcttggaatctaagtgtctctgtgtcaccaccttctacttccaaatgtggcacccctgtgggaaccctgaggttgtgtgtcctctaac

SEQ ID NO: 737092 - DNA, 14809 bp, Homo sapiens
  misc_feature (1026)..(1026): n is a, c, g, or t
  misc_feature (1759)..(1759): n is a, c, g, or t
  misc_feature (3108)..(3108): n is a, c, g, or t
  misc_feature (3182)..(3182): n is a, c, g, or t
  misc_feature (4398)..(4399): n is a, c, g, or t
  misc_feature (4673)..(4673): n is a, c, g, or t
  misc_feature (4708)..(4708): n is a, c, g, or t
  misc_feature (4776)..(4776): n is a, c, g, or t
  misc_feature (4818)..(4818): n is a, c, g, or t
  misc_feature (5262)..(5262): n is a, c, g, or t
  misc_feature (6200)..(6200): n is a, c, g, or t
  misc_feature (7220)..(7220): n is a, c, g, or t
  misc_feature (14716)..(14716): n is a, c, g, or t
  misc_feature (14727)..(14727): n is a, c, g, or t
  misc_feature (14734)..(14734): n is a, c, g, or t
  misc_feature (14736)..(14736): n is a, c, g, or t
  misc_feature (14742)..(14742): n is a, c, g, or t
  misc_feature (14750)..(14750): n is a, c, g, or t
  misc_feature (14752)..(14752): n is a, c, g, or t
  misc_feature (14757)..(14757): n is a, c, g, or t
  misc_feature (14763)..(14763): n is a, c, g, or t
  misc_feature (14768)..(14768): n is a, c, g, or t
  misc_feature (14779)..(14780): n is a, c, g, or t
  misc_feature (14782)..(14783): n is a, c, g, or t
  misc_feature (14785)..(14785): n is a, c, g, or t
  misc_feature (14789)..(14789): n is a, c, g, or t
  misc_feature (14796)..(14796): n is a, c, g, or t
  misc_feature (14800)..(14801): n is a, c, g, or t
  misc_feature (14803)..(14803): n is a, c, g, or t
  misc_feature (14805)..(14808): n is a, c, g, or t
agcatgacttacagaagcctttaattataatttaccatttctggccaggcacagtagctcatgcctgtaacaccatcactttgggaggctgaggcgggatgattacttgagcccgggagttcaagaccagcctgggaaacagggagacccctgtctcttaaaaaaagaaaatcaaaaaatgagccaggcatggtggctcacacctgtggttctagctactgaggaggctgaggaaggaggatgatgagcctgcgcagtttaaactgcgccacttcactccagcctgggtgataagattatgtctcaaaacaaaacaaaaaggccacatcacattgtacactttaaatataaacaatttttgcttgtcaattataactcaataaagctggggcaggtaggggacacggcagtacagtaaaaatccctcacctatctgcttgcacaaatgcaagcagatttccatctgggcagcttttttcaaacttttggcagttgcatcctcacaactgccttattacttaattacataatatttaaccccttatgcttaaaaaaaaaacccacgaaactacagacttcatcagtctttgcactaatgtcctcttgttgaggaagaatctccttcagggtgggacgatgcacttagcagtcacatctctgtggccacaaaggctgcttctcatttataccgggagaaacgttgccagcacagctgctgtgcaggcttaagcaaattgttttcaccctgtgagcctcaggcctctcttctataagatgagaaaacacccttgtttgggaatatctaataagatactgacatgaaaaggccttatgaacgcaaaagcgtgacacacctgtgtgttctctcggtgctgctgggatgtgcgtttgctgaatgtgtgtcatctacaagctggtcaaggatggaaaatgccttccctcctaacattcagaagggaatgaaaaccctctttcctcctggaatacagaggaggaaagaacttcatctttacacccaagccaagncaccagagattcttgacatgttcagatacgacttggggatcataaaatgttcaggaaaccctgcaggactgacttacagttttttttgcctatagtttgtgggcacccggggcccagccaccccatcgcctgggcagcaggtgcaggtctgaggcctccgggcccaccatcccccaggccttgggagatggctgtgagaacacccccttcagttaaactgcacccaggatgccagcccacccagctgtgaaagcccctgggaggagggctcatggcgggacatccctgtggaagctggcaactcaagggacacagtgacatttgctttcctcaggaaattgtgtctgctcctcctccacctgtacccctttgaacagacagcagctccatgaaagttctctttgcagtggattccagccaggaataggcaaggtccatggccagccactgcatcctgtggcctcccgtggtgtgaaggacaccctgggcacagtgcctccggaagctctgtagtgtgaatatcccactgtcttcaacaaatacgttgcagggaaataaggaacaacaggggtcctgtgaaggaggcagaaaatccagcctgaaggctggcagtggtgtttggagatgcagcggagcaggcagcagtgaagagggtcaggagggcaggccactcctggaggctgtgggggcattgcttctcccaggtccaggaggccctgcaaggggctggccngcacagccatcttctctgcaccctccacggccctgtccgggagggggtggggcacgtattcgagcacacacaatgcacacacacttctgcatggctggggcagctcagggccaagctcctggtgggggagtgggctctccttccagcctttcctttctccctggtgctgtggactgaatgtgtgtcccggagattcacacgttgaaatgctcacccccaaggtgacaggattagaacgtgagcttttggaagtgatcagtcatgagataaggctgcagaatggcataaccgttactccagagacccctcaccctccttctgattgaggacacatgagagatgttggccattgcccggaagagcctgaggtacgctgtgaggacacatagaggcctggcactggatcagggatggggcgaagcagctcactgcagctttgacctcctgggctcaagccatcctcctgcttcagtctcttgagtagctgggacagcaggcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcggtgagctcctgggtgcggggcgcgcgggcccaggctcctccgcaacccgtgcacctgggtcctttcgcccttgcggtctgccgtttcccacccgcgtctgtccggtcgtggaatccagggttgcaggtgtccgttccagtcttctctcctggcagagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactnaccatctcccagtgctgcctggaggatgtgggccaggtggcctttatggctggcgactgccagacgtccacccngttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagnnccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccantgccacgctgagctgcgaggtggcccaggcccagncggaggtgatgtggtacaaagatgggaagaagctgagctccagcttgaaagtgcatgtagaggccaanggctgcagacggaggctggtggtgcagcaggcaggcaagacngatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacngaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggncgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcggatgctggggagtacagctgtgaggcggggggccaacggctgtccttccgcctgcacgtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcntcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggccgcaacatccagatcgtgaggcccctggaggatgtggaagtgatggagaaggacggtgccaccttctcctgtgaggtctcccacgacgaagtgcctggccagtggttctgggagggcagtaaactgcggcccactgacaacgtgcgcatccgccaggaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacggctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcagggccctgcctgccaggttcacagagggtctgaggaatgaagaggccatggaaggggccacagccacactgcaatgtgagctgagcaaggcagcccctgtggagtggaggaaaggccttgaggctctcagagatggggacaaatacagcctgagacaagacggggctgtgtgtgagctgcagattcatggcctggctatggcagataacggggtgtactcatgtgtgtgtgggcaggagaggacctcagctacactcactgtcagggccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcagggccctgccggccagattcatagaagatgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcagggccctgccagccagattcatagacaacatgacaaaccaggaagccagagaaggggccacggccacactgcactgtgaactgagcaaggtggcccctgtggagtggaggaagggacctgaaaccctccgagatggggacagacacagcctgaggcaggagaatngcttgaacccnggaggcngnggttgnagtgagcnangatcntgccantgcantccagcctggnnannanagcnagctctntccnntngnnnng

SEQ ID NO: 737093 - DNA, 1302 bp, Homo sapiens
ggtccgaatttcgggaatcgtcgacccacgcgtccgtaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacagtaaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcaaaaaaaaaa

SEQ ID NO: 737094 - DNA, 1545 bp, Homo sapiens
tagtgcagttaattaaaaatatatcagactttttgctttaatgtgtacctttactgatgaggccagatagtctctagtcaggttaattttttacagatctagaaggattattattttactttatttttaacataaaatgatgtactgtgccactaaacatattgttaatttcaaatataggaagatttttttttaataaaaagcttggtaattagttactcttcaaattgtatttgtgtctttgattttctaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacagtaaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcaaaaaaaaaa

SEQ ID NO: 737095 - DNA, 2075 bp, Homo sapiens
tattattgttattttattttttgtagagacagggtctctctgtgtagcccaggcttgtcttgaactcctgggctcaagtaatcctcctgcatcacctcccaaagtattgggattacaggcgtgagtcaccacgcccaaccagcttcagtttttgattcacctccatagttaggggcatttattaagatttaaacaacttttttctgttttaccttttatatatttttatattttccatagtttgacttcaaatatgttcatgtagaatggggacttaatgtttttatttatgagggatttatgctcatatgtggctctgcctactattgttatttagttggatattttaggtagatgcccttacattgtgttttatctttgaaatataagtaaatatataccatttgaatcttagtcattattttctccaatatatatacatcatttaagaattatttttaaggaatctattttaatattctcacgttctaaaaacttgtcttcaaattgagcctttccaaagtcattttggggacatgtatcatgcagcacaacttactgacatttagcttccttcttgtgaaaggattatctcttaagtattttggtatggcaattatatgaaagtttaattcactcctaacatgtcagttgcattagacacttaagaatgttgttggttgcaggtggctcgagtcttttattatctttgtgtcattgcactgcagtatgtggcgcctctggtaatgctgcttcacacaactctgcttttgaaaacactaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacagtaaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcaaaaaaaaaa

SEQ ID NO: 737096 - DNA, 998 bp, Homo sapiens
cagtggtcccaagtaaaagctcagcagattgaaagatcccatccaagtaggtatatgatcaggcaaagctgtaaccagtgatgctgggtgattgacttgattagtcccacaggcaatccctgcagttttctttctttccccaacttgtcttttcatgtcacagccagtttttatccatggaggagggtatatagagaaaaggatctcatgtattgctctacttttttcttctagatacctgttaacttcttacgctttcatgatacatttatctagttctgttattcaagttaaagtattatacagttaagtctatggcagagtcagattcttttatgtgtctaactgttgcgaagtatagacttcttatatcttatatggtgaccattaacatataacgagcatgctagcatattgttgtctttgagagcaccgtatcaactttttgatctgtagaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtaagttttataccctagtcaaaatgaaaaatagcaaaaaccgcactgtaaaaaaaaaaaaaaattggtttcctttagtagatagtatttcaacccatcatattcttattataaataaacagaacaatcttaagttgacagatatcaaagagaccttgatctgattttggtgccaagtgaggtcttaattcctcttcctgccttaagtgcttggtgtcatacagtgggtggtacaaagctgttttatgcctaatattgctaaatgggacccttctaattgatttgaaagacattataacatattgtccagactttaagacttaaagagtaggaaatactacttttagtggctaaatttattcatttt

SEQ ID NO: 737097 - DNA, 428 bp, Homo sapiens
aacagttatctaatactaataccttaatattattatctaatactagtttatatttctacagttaggcaactgtattttagcagaagatgatggtgaggaaacaaacagtttattaataggcattaataactagacttgatctgttaaccttgtagaactgttagagtaatagaaagtttcagacagaattggttcaaactccagctctcctcctcactaaaatcttcatttgaggcagattatttaacttcactgagcctctgtttccccatctggaagatgaagataatagtatctaactcacaaggttatcattggaataaatgaaagaacacatgtaatgcaaccagctggaattaagtgcttaataaatgttcttttcactgctttgcctcatcagaattaaaatagaaatacttgactagtca

SEQ ID NO: 737098 - DNA, 1034 bp, Homo sapiens
ttccggcagagccggaagaccctctctttcgctgtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatgtatccttcaaaacatcattaatattaatttattttgcagataacaccattagatctcatctctgatttgagaaagattttatgtcattagataacttttctttattgaaatcttttttatgtaattgaaaatatttttcaaagtaatagaggtaaataatttaaaaagctaaatataagaaaaatgccagtgccctgctttttcttatccaagtctaatgtcacagagacagccacattcacctcttttaggcatttcttttgggaattccttccttgtgtttaaatattttgtgataatgttactatttatatattattgcacctttctccctcttcccttttcttcccttctttcattctcccaaaatagttagagataacattttattaaatttatagtcacttttaccatgttgtgcctatgaaaatattatttacagccaggcattatagtgt

SEQ ID NO: 737099 - DNA, 2505 bp, Homo sapiens
ttccggcagagccggaagaccctctctttcgctgtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaagtatcaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacagtaaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcaaaaaaaaaa

SEQ ID NO: 737100 - DNA, 2602 bp, Homo sapiens
ttccggcagagccggaagaccctctctttcgctgtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaagtatcaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtggctcgagtcttttattatctttgtgtcattgcactgcagtatgtggcgcctctggtaatgctgcttcacacaactctgcttttgaaaacactaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacagtaaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcaaaaaaaaaa

SEQ ID NO: 737101 - DNA, 1203 bp, Homo sapiens
ttccggcagagccggaagaccctctctttcgctgtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaagtatctttccccatctggaagatgaagataatagtatctaactcacaaggttatcattggaataaatgaaagaacacatgtaatgcaaccagctggaattaagtgcttaataaatgttcttttcactgctttgcctcatcagaattaaaatagaaatacttgactagtca

SEQ ID NO: 737102 - DNA, 2467 bp, Homo sapiens
ttccggcagagccggaagaccctctctttcgctgtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaattagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaagtatcaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacagtaaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcaaaaaaaaaa

SEQ ID NO: 737103 - DNA, 2401 bp, Homo sapiens
ttccggcagagccggaagaccctctctttcgctgtttgagagtctctcggctcaaggaccgggaggtaagaggtttgggactgccccggcaactccagggtgtctggtccacgacctatcctaggcgccatgtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaagtatcaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacagtaaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcaaaaaaaaaa

SEQ ID NO: 737104 - DNA, 844 bp, Homo sapiens
tgtgacattatgtaattgtgtacttgagaataacgtgcaaaaatacaataatgtcacacatccctatatattttctttttatgtattttactttctttacaaagaaattaattcttttttttctttttaataaaaactgttactcattaactttgcttataatgctttttatagcccagcacagaatttaaagccataccaccaaaagtacctgtgtgtgttaatatgtttttcttgtagcatagattgactatttgcaatagtattagtatttaccatttttccaaattagcaactaccagacctcacgtgttgcagtgataacacaatgcattggattcagttttgtgaaaatggattctgtggccatccaagggatgtatcagggatgatcagctgatgagaggctccagaaggatttctagatcgcttcaagcctatactgatggccttagctttgttcagtcattgtaactgggattgttgtcattgctaccgtggtagtcaccttcatgtcatctataatagtactcctggagagccctggctgcctacaccagtggaaaagagtctccagttctgctctggcctactaactgttaccactgagagaacaacatgttcatttgacatgattgaagctggcatccgtatatgaagatccttgtcaagctttcttctgtggtctgattagtgtgataccggggcctcctcgataccttaagtgttgtcacaatgttactttcggatgtgtaagctacaaaataaaatcttgctagaaaaaaaaaaggggggtctaaaatccaggcaaatccaccccttttaagggcccaaaagggtaaac

SEQ ID NO: 737105 - DNA, 3069 bp, Homo sapiens; identical to SEQ ID NO: 96912

SEQ ID NO: 737106 - DNA, 3737 bp, Homo sapiens
gaaatttgcatatccactccagttctgtcaccaaagattttaatcttcagatcgcaatttcctctctcccagaaaaaagtactacaacaggctcaagggatatgctttggtggtcaagggattacactatggttttccttctgttcacaatggtatttacaggagaccttgtcatcagaggacgtactgaactatctttatgactttggatttgatcagaggtttaaaaaatagaaaaaaataaacaaccactacttgacactgtaaatgatctttaatagagtcatgacctggagactgatggagagaaagaaacttccatggaagagagtgagctaaatcatttagaaccaaacaaaggtcactggtgaaacatagggcagcatgtacacagtgcagatcagggttctgtatggccagagccaacagcagtgaccggtgggagagtcagacaactggccaatgaattcaagtgttgaaaaagccacagtctggattttgttgtgatttctggagtggttgaaacgcccatgcccatggcaaggaaaatgcttggaggctgatctgttgtgatagtgcctttcttgtcgtagtgagtactagattaataatttattcagttacgcttttctgtaccattgcctccagtcttctgaggaggtttgaagggacagtatccacttaggatgaagggacaggatattgctctggaatgctgtgatttgatgatatttgcactagattctaaactctcctttaaactggagcaactgactgagagaaaaaccaaggacagctcaaagttaaaagaaaccaaaagcagtattttctgacagataccatttctttttctccttctttttttcctggaagaaaacttcacactagttggctaccgagctcaactcttaccagttctttctctttattttttgtttccatatggaaccatctgtgtgaattagtcatcagttaggtatagttaacgtaaagagcccctgccattgaaactttgcacaccttctctgctttattgaaggcaagggccagtgggcagtgatagcaggggagggaccctccagaaccacccagccctccaggaggccaataagcatggatatcatgtcaggagctgagctgacatatatttactcagaggacattggggtctgtagctaatcctaaagaatgctccgcaacagaaggaaaccaatgcattgtagaaaacaaagggagatggtgcccgaagtctgcctgtttctcttctcttttctttcccatctcaccaccatgtcctctctaacagaattatatttcatctcatatattatatgttactagaaaagtcatttggttccttggtttctctctttatcagtgggctggaaattcctccaaattaaatataactaccagtagcagctcccctgtgtccagccagtttctcaaatgctgtccacctggtcttactgtccacctaacataacttggaggctttggctggctcaaccacctgttcactttattttgttttcatttccatttgaacttgaagtgaggctatggaaaggtggaaatcatgggcaaggtttggaggctgcaattctagggcatagcttgtcaggagtttatattatctaaaatatatctttctataccccttttcattttaatctgttgccctgattataatttctttatatttgtggttatttttataagaatagagtccatttgctatgtctatttgagtactttttttctattgtccccacatggatgcagtaccaacctgttaatgaaatatctttttattatattattaatatgtaattctactgtagaccaaaaatataaaaacaaatttgttcattttaaagatataaagaactagggagtaaaagattaaaagttgaaggaaaagacagaagagcagtggttaactatgttgagttagaaatctaagagtagccttacctgttttttaaccagtgcttgccaatcataccatagttggaattatgtaatcttggctccttcatacttatgttctataattcttgtttgtctatttgttttctttgatgtaattgaggttgcacatcatgctattcttggcaatgcctgattctattgtattgtacttttgttagtcatttcctttagaaagatggggggaaacgtttatttcttcttttaatttaaaatttgtttaatgcactggaaataaaattggacatatttcactgtttaaaaaatcagaaacaaaacaaagcaaaaccatgagggaaaaaaacagcaaataagcaacaggggaaaacagctatgaaaaaaatatatttgtactgaatacacatacaaactacatcccacatgaaagattaatatcatcaagtaagaaaaatacatagtttaaactacaatgctgaaaatataaaaggaacctggtagttcaatggggatggagaaaacagagcattcctctgagagcagagatcttgtcattattgcaattaatgcccaaacaggttaaatgtggaagaaagtatggaggaaataaccccagccttcctcataccactggatttccacatcaccttttaacttatgcttgagctcccttttgagaaaaaatatttaaaaacaaattggctatgtaacaaatttgtgtgtgtgtgtgtatatatatatgtatatgcttatatatatatatatgtatatgcttgagaaagtggtttttcaagatgtatgtgtacagtacacacatggacacgcttcagtcctctgacttcccatgtgctacctcatgtgtttctcttctcatgaggatttgcaatggatagttgtacaacctggggactgtcagtgactcattggtatcagcatatgctaaagaagctcttgaatccaatcttgaaacctgatctcccttcgtcaacattccccaataccaaactggcccgtttacccatacaaatgcacagtaaagggaagaacagcggtatttttcctagccaactgactctatcatttgtttaatgtttgctggtttttttctggttttgttttgttttagagcaggggtgggagtggctgtaacttcacaatcctaatacagtaaatgttttgcatcttccatgttttatgcaaaaacagacatttaaatcaataaataattgtgccctagactgaaggttaatgtttaggagaggaaaaaaattgttggaattttttctacatttttttgtgaagaatcttttttggaaaggaaggatacatatttttgttgtgtaatattttctatttttgaatgcattttattggtacaagactgtttttttggtgaagacattatttaaaaaaaaaaaaagaaaaaaactaatcgaaaagtttgcccttaaggatatgctgcagttttgaggttaaaaaaaaattactgattcaagatgcgtgttaaaagttgggattatattgttgttttttgtaattgttacaagaagaagtttgtacccactgctgtttattttgtttcagatgagtaagtaaagggattgttcttgttttattctttttttagagaaaaaaagctatttatgaaatgtcaaaaacactggactgtgagtttaagtgtggaagcattttaccaccctgtgtcttcaaccaattatgggaaaccccttttctcttccccctaccccctgccttagccttgccaaatgagaaaaatataacagctg

SEQ ID NO: 737107 - DNA, 482 bp, Homo sapiens
gggtgatagttgattctagagtatcccctgcagctctctgatgataaggatcccaagtcaatgggaatgaaattcaactggcgggcaagttcaataacctgttgtcgcgcttgaatattgttgctgcatatataaacctgccggctggcatccttaggtcctaactgaagtgcccaagctgagacaacattaaatcctttgacaatcaaagaatctgggaataatgaagccaaatattcagcattggattctgggtactggtttatcctcatgttattgctcacatcaatcaggattttacccacaagcagatgtctcaggtcccacagggaggtataatgttctctgtgtatagcaacaaatattatatttgtttttgtgagagcatcttcatgatgagtgacatctaccacatgaggaaaaaattcagaagcaaacttaggatttctacttcctatgaccacatgatagccgcatctaat

SEQ ID NO: 737108 - DNA, 630 bp, Homo sapiens
atctctctgaccttctcatcggtaagcagaggctgtaggcaacatggaccatagcgaagaaaaaacttagtaatccaagctgttttctacactgtaaccaggtttccaaccaaggtggaaatctcctatacttggtgccgtaataaagttgataagcagctgccagaagacctgcgaggtatactagggagagcaaagtaatggcaactataggtaaggttttattcacaatctctataggaattttgtaaaagtcactctgttggtttctagcatatggatgaatcacatctctgacaaaggaataaaggaaaaaaaatgtggccaagcttatagctaccaccactggccctctccagagagtaaagagtcgtaggggtaaattttcaatctctctggctgatgataaggatcccaagtcaatgggaatgaaattcaactggcgggcaagttcaataacctgttgtcgcgcttgaatattgttgctgcatatataaacctgtggaaaaaacaaaaagactcagcattaccattgttgtttataaaaatggtagcaatcgcatgctccacttacggaccatcacctgtgatgaccttgaggaataaatacttgttgaattttcgtctata

SEQ ID NO: 737109 - DNA, 466 bp, Homo sapiens; identical to SEQ ID NO: 414516

SEQ ID NO: 737110 - DNA, 3658 bp, Homo sapiens
gaggggcggagaggcagagagcccgaaaggaccagacgcccaggtcgcccgcatcccgctgccgcaggagagagacagcgcgccccggccctgctccccaggcttcgccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggggaagccatatgtttttgaccgtgtattccccccaaacacgactcaagagcaagtttatcatgcatgtgccatgcagattgtcaaagatgtccttgctggctacaatggcaccatttttgcttatggacagacatcctcagggaaaacacataccatggagggaaagctgcacgaccctcagctgatgggaatcattcctcgaattgcccgagacatcttcaaccacatctactccatggatgagaaccttgagttccacatcaaggtttcttactttgaaatttacctggacaaaattcgtgaccttctggatgtgaccaagacaaatctgtccgtgcacgaggacaagaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtccacccgaggagacaacgagaaggtccagcgggagctgagccacctgcaatcagagaacgatgccgctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgcagatgaagtgaagaaggctctggagctgcagatggagagtcaccgggaggcccatcaccggcagctggcccggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtagtgagtgaccacacgtgtgggttggagtcccacccaaagctccctggaccctagaaggcatagggtgggggcagttattggttgtggcttaattattttcctaaaccctttctcaacttcatgcctatgattagaaggtaggtgtctgccctcccagcctgtggccatgtttgttttcctctgctctctggggatggggagggctgagcagctctatcgctgaggatgagtgtggattagtggtcctcagactagtggagggtgggtgtcagaggctgcctctttcctctgctccatccagctttgcaaactcctgtaccagcagtggagccacatcttctggcggccccttggcttcctaccagaaggccaacatggacaatggtgagtgaaaaagatgggtaatcccacctttggggtcctcagggcaagttgagaggcataaaagttagtgaccttagtgtacaaaaaacactgactgaacctttctggtgtgccaaggcttca

SEQ ID NO: 737111 - DNA, 5074 bp, Homo sapiens
gaggggcggagaggcagagagcccgaaaggaccagacgcccaggtcgcccgcatcccgctgccgcaggagagagacagcgcgccccggccctgctccccaggcttcgccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggggaagccatatgtttttgaccgtgtattccccccaaacacgactcaagagcaagtttatcatgcatgtgccatgcagattgtcaaagatgtccttgctggctacaatggcaccatttttgcttatggacagacatcctcagggaaaacacataccatggagggaaagctgcacgaccctcagctgatgggaatcattcctcgaattgcccgagacatcttcaaccacatctactccatggatgagaaccttgagttccacatcaaggtttcttactttgaaatttacctggacaaaattcgtgaccttctggatgtgaccaagacaaatctgtccgtgcacgaggacaagaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtccacccgaggagacaacgagaaggtccagcgggagctgagccacctgcaatcagagaacgatgccgctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgcagatgaagtgaagaaggctctggagctgcagatggagagtcaccgggaggcccatcaccggcagctggcccggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattccttgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccctgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggcccatgactccttcaaggaaaagaggccctgctccctttacctgctgagctccttttagcagttagggagaactgcagggggaaaaataccagtggagtgtggaataaatccaaagcagtgatttttaaatgtttttcaaaaacaaatcttacatagaaccccaatataaaaaataaagtaatgcagacctgggcagtttgca

SEQ ID NO: 737112 - DNA, 5003 bp, Homo sapiens
  misc_feature (5000)..(5000): n is a, c, g, or t
gaggggcggagaggcagagagcccgaaaggaccagacgcccaggtcgcccgcatcccgctgccgcaggagagagacagcgcgccccggccctgctccccaggcttcgccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggggaagccatatgtttttgaccgtgtattccccccaaacacgactcaagagcaagtttatcatgcatgtgccatgcagattgtcaaagatgtccttgctggctacaatggcaccatttttgcttatggacagacatcctcagggaaaacacataccatggagggaaagctgcacgaccctcagctgatgggaatcattcctcgaattgcccgagacatcttcaaccacatctactccatggatgagaaccttgagttccacatcaaggtttcttactttgaaatttacctggacaaaattcgtgaccttctggatgtgaccaagacaaatctgtccgtgcacgaggacaagaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtccacccgaggagacaacgagaaggtccagcgggagctgagccacctgcaatcagagaacgatgccgctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgcagatgaagtgaagaaggctctggagctgcagatggagagtcaccgggaggcccatcaccggcagctggcccggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattccttgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccctgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggccccttcctcagaacaatggttttcaaactactccacagaatcctcagggtctcttaggactgttcaagggctcatttgctgaggagcctttgaacagtcagtcctaagagacgctgagacttcttccncca

SEQ ID NO: 737113 - DNA, 4267 bp, Homo sapiens
gaggggcggagaggcagagagcccgaaaggaccagacgcccaggtcgcccgcatcccgctgccgcaggagagagacagcgcgccccggccctgctccccaggcttcgccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggggaagccatatgtttttgaccgtgtattccccccaaacacgactcaagagcaagtttatcatgcatgtgccatgcagattgtcaaagatgtccttgctggctacaatggcaccatttttgcttatggacagacatcctcagggaaaacacataccatggagggaaagctgcacgaccctcagctgatgggaatcattcctcgaattgcccgagacatcttcaaccacatctactccatggatgagaaccttgagttccacatcaaggtttcttactttgaaatttacctggacaaaattcgtgaccttctggatgtgaccaagacaaatctgtccgtgcacgaggacaagaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtccacccgaggagacaacgagaaggtccagcgggagctgagccacctgcaatcagagaacgatgccgctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgcagatgaagtgaagaaggctctggagctgcagatggagagtcaccgggaggcccatcaccggcagctggcccggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattcctggtgacatggctgcaggtatcctctagaacagc

SEQ ID NO: 737114 - DNA, 3628 bp, Homo sapiens
  misc_feature (3625)..(3625): n is a, c, g, or t
gaggggcggagaggcagagagcccgaaaggaccagacgcccaggtcgcccgcatcccgctgccgcaggagagagacagcgcgccccggccctgctccccaggcttcgccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggggaagccatatgtttttgaccgtgtattccccccaaacacgactcaagagcaagtttatcatgcatgtgccatgcagattgtcaaagatgtccttgctggctacaatggcaccatttttgcttatggacagacatcctcagggaaaacacataccatggagggaaagctgcacgaccctcagctgatgggaatcattcctcgaattgcccgagacatcttcaaccacatctactccatggatgagaaccttgagttccacatcaaggtttcttactttgaaatttacctggacaaaattcgtgaccttctggatgtgaccaagacaaatctgtccgtgcacgaggacaagaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtccacccgaggagacaacgagaaggtccagcgggagctgagccacctgcaatcagagaacgatgccgctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgcagatgaagtgaagaaggctctggagctgcagatggagagtcaccgggaggcccatcaccggcagctggcccggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagctgctgagctccttttagcagttagggagaactgcagggggaaaaataccagtggagtgtggaataaatccaaagcagtgatttttaaatgtttttcaaaaacaaatcttacatagaacccccttcctcagaacaatggttttcaaactactccacagaatcctcagggtctcttaggactgttcaagggctcatttgctgaggagcctttgaacagtcagtcctaagagacgctgagacttcttccncca

SEQ ID NO: 737115 - DNA, 4264 bp, Homo sapiens
gtttctcccttgctcctgcagacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtccacccgaggagacaacgagaaggtccagcgggagctgagccacctgcaatcagagaacgatgccgctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgcagatgaagtgaagaaggctctggagctgcagatggagagtcaccgggaggcccatcaccggcagctggcccggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattccttgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccctgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggcccatgactccttcaaggaaaagaggccctgctccctttacctgctgagctccttttagcagttagggagaactgcagggggaaaaataccagtggagtgtggaataaatccaaagcagtgatttttaaatgtttttcaaaaacaaatcttacatagaaccccaatataaaaaataaagtaatgcagacctgggcagtttgca

SEQ ID NO: 737116 - DNA, 1103 bp, Homo sapiens
ggtccggaattctccggatagcttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattccttgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccctgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggcccatgactccttcaaggaaaagaggccctgctccctttacctgctgagctccttttagcagttagggagaactgcagggggaaaaataccagtggagtgtggaataaatccaaagcagtgatttttaaatgtttttcaaaaacaaatcttacatagaaccccaatataaaaaataaagtaatgcagacctgggcagtttgca

SEQ ID NO: 737117 - DNA, 2279 bp, Homo sapiens
  misc_feature (16)..(16): n is a, c, g, or t
actcactataggaatntgccctcgagccaagaatcggcacgaggggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattccttgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccctgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggcccatgactccttcaaggaaaagaggccctgctccctttacctgctgagctccttttagcagttagggagaactgcagggggaaaaataccagtggagtgtggaataaatccaaagcagtgatttttaaatgtttttcaaaaacaaatcttacatagaaccccaatataaaaaataaagtaatgcagacctgggcagtttgca

SEQ ID NO: 737118 - DNA, 2175 bp, Homo sapiens
ggtagtcagctcggtaccgggcagtacggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattccttgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccctgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggcccatgactccttcaaggaaaagaggccctgctccctttacctgctgagctccttttagcagttagggagaactgcagggggaaaaataccagtggagtgtggaataaatccaaagcagtgatttttaaatgtttttcaaaaacaaatcttacatagaaccccaatataaaaaataaagtaatgcagacctgggcagtttgca

SEQ ID NO: 737119 - DNA, 4963 bp, Homo sapiens
atctagaggatcccagtccgttagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggggaagccatatgtttttgaccgtgtattccccccaaacacgactcaagagcaagtttatcatgcatgtgccatgcagattgtcaaagatgtccttgctggctacaatggcaccatttttgcttatggacagacatcctcagggaaaacacataccatggagggaaagctgcacgaccctcagctgatgggaatcattcctcgaattgcccgagacatcttcaaccacatctactccatggatgagaaccttgagttccacatcaaggtttcttactttgaaatttacctggacaaaattcgtgaccttctggatgtgaccaagacaaatctgtccgtgcacgaggacaagaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtccacccgaggagacaacgagaaggtccagcgggagctgagccacctgcaatcagagaacgatgccgctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgcagatgaagtgaagaaggctctggagctgcagatggagagtcaccgggaggcccatcaccggcagctggcccggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattccttgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccctgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggcccatgactccttcaaggaaaagaggccctgctccctttacctgctgagctccttttagcagttagggagaactgcagggggaaaaataccagtggagtgtggaataaatccaaagcagtgatttttaaatgtttttcaaaaacaaatcttacatagaaccccaatataaaaaataaagtaatgcagacctgggcagtttgca

SEQ ID NO: 737120 - DNA, 4588 bp, Homo sapiens
tcagctcggtaccttcttgcacccatggttgtagttctaaggaggtgggatgtgggattctgccaagacgtgggcagccctcaccccaaccagttcagccaaaagtgagggtgcctccctgggtggggacccagcaccaaaccacagtccttgaccccacagagagagcgtcgacgctctctctgtggagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtccacccgaggagacaacgagaaggtccagcgggagctgagccacctgcaatcagagaacgatgccgctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgcagatgaagtgaagaaggctctggagctgcagatggagagtcaccgggaggcccatcaccggcagctggcccggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtagtgagtgaccacacgtgtgggttggagtcccacccaaagctccctggaccctagaaggcatagggtgggggcagttattggttgtggcttaattattttcctaaaccctttctcaacttcatgcctatgattagaaggtaggtgtctgccctcccagcctgtggccatgtttgttttcctctgctctctggggatggggagggctgagcagctctatcgctgaggatgagtgtggattagtggtcctcagactagtggagggtgggtgtcagaggctgcctctttcctctgctccatccagctttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattccttgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccctgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggcccatgactccttcaaggaaaagaggccctgctccctttacctgctgagctccttttagcagttagggagaactgcagggggaaaaataccagtggagtgtggaataaatccaaagcagtgatttttaaatgtttttcaaaaacaaatcttacatagaaccccaatataaaaaataaagtaatgcagacctgggcagtttgca

SEQ ID NO: 737121 - DNA, 649 bp, Homo sapiens
cagcacagtgtacagcaggccagccaacttgctcttccctgcgctgtagccagagaccgggcttatgtaggcgtagaagacagcggtgtaatacatgcacaccacggtgaggtgggaagagcaggtggagaaggctttctgcctcccccaggcagtcttcaccttcaggatgctggagacgatgaagccataggacgcgatggtcatcaggaagttcactatgccgtagaaagcatccgccaggacaatcatgacaccgttgacgtaggtggagctgcaggagagaagcagcaggggagggacctcgcagaagaaatggataatgacattggggccacagaaatccaagcgcagcatcagccccgtgtggatggccgtgttgacggcgcagagcagccacacggctgtggccagcccgctgcagaacaccttgctcatcatgctgctgtaatgcagcgggtggcagatggctgcgtaccggtcataggccatgaccgtgaggagcagcagctctgaggatgcagcccacgtgaggaaatagagctgggccatgcagcccccgtaggagatggagctctcttccgacaccagactggccagcgccttgggcatgatggaagaggtgcagataatgtccatagtagccaag

SEQ ID NO: 737122 - DNA, 2828 bp, Homo sapiens
cgtctggctaatttttgtatttttagtagagacggggtttctccatgttggtcaggctggtctcaaactcccgacctcaggtgatccgcccgcctcggcctcccaaagtgctgaaattacaggtgtgagccactgcacccggccaaacttattgttttaatcccagcatttatgtttagaagaattaatttaaatatttcttactatttctctgtcgaatgtttactctcatcttatctcaatgaaagaagtattaaaagtcttatggccccaaaagaaacaagccaaactgtactgtcttaaaagtgattcattctgagcttgaaacgactctgtcagtgtttgacattgtcatttctagtggcatgtatcttaacattcttttcctgcttcaggaatgaaatcacttgtcctgctgagaaaataaggggaaaacaagatagaagtaaaaaacaacacacctgttgaactattttcataaagatggcgttttcactttcaaaagaaatgaaaaccagatggtctatgctaagaagtgaaggcattttgttgtcttcagaactgatcaacatggtcatgatcatcatcaaatttcttgtttccaaaggccactattgtagtacagtctccagcaggattttgtaccatgtgctgcctttggaataaagtattataatgtatcttgtcaccttcatcaacaccaccattaaatatgtaagttcctatatgtgactttttctgggcatatttgcatcaaaaatcacagtccttgcctccttgcttgcttttactccatgaaacgcttcatgaagcagagcatgattgtcaagtgaccagaggatgacatttgtaagtgaacgtgggtatactcacacatgctatactcatactacataacttagtttctccaaatcaactgcagtccgttttatctatgatattcctggcttcgtataatggttttgtaaaatacattaaatacaattaagtccgttattactatgctggaaataactaggtcagacaatgaaaccttagacttttgattggggctgtttggacttgatccaatgataaggtaataaggttgttgcaatttctcaaagcatcttaattctcaaactgaaacatttagcaaatacatggtgaatctggtgtaaacttacaatctaacaaataattttctttcaactcttctctttttctgcctaacaatctatacgaaattgccaatatctaagcaatcaaaagtttctgaaatctctgtttccttagtagaaatgaccttgacaacttattttctgagataccactaggcctactgtctttcatgccattttatataaacattttgatagatactctgtcttttgttttttatctcttctcttttcaagagtcacttgactttttcaaatattcttaaaagatagatttagttattgtattttggtctacaattttggacttggcagtttgttttactaatgcagaattattctttttgtttcaaacatagtttgccatcatctggctactacctaatcatgttgtactagttattgtggaaagaaaattgtacatacatttccttgtcctttgggagatgtctttgagtcaaacccacaagcatgaactctcacctgaaagaaaactggaaaaggagaaactttaaatcagtatgttttgaaaggaagagatttccagactttttaaagcaaattggaatcgttttatttttttgtttgggccttaggcacaatagaagcaaatgttgcaatattaaatataatagggagagttcactgtttcctgggacattgtggtcatgtccttaatccttcattgtgatgccccttcttggagttggcattttgtgacaattcatagagatcttgcagcaatatttggctattggttttattaacttaaaattcaacagaaatggagtaattaaaaaaaaaaaacaaaaaacagagaagaattgcaaaatctgaagtggaatggcacttccttgggtatgtaagggttgtttttagataaaactcccgatttgttcttcctacactttaatagtctcaaattctttctggggaagcaacgtcagtgtctacctccacagtaactatgatataggaaattgtcctttcagtggtttctaggtataacaaacaagccgttaaaaatgagtgaccattttgtaggttacagcctcagcaatctgtgtcatttgaaagcaaatatcctgatatttttaaataaggtgagcagggcaggcaggaaaccaatatttagtacttttgtgattaaacattctagaccaggcttgttgatatgtatgccaatagcctagaatttttggcttagtgtaaaataaaaatgtcttttctattgtggtctgatatccgtttctgtaataagatcagtttgttgtcctctgtgcaccagtggttttgcccttaattttttttggctagcatcaccaagatctgtcatccagagctgctgagaaaaatacatgttgccaaacttttcttaaaattgtgctgccagtggtattttcccagatgtgaaaaataataatctaataaaggattaatatctaataacaataccattgttgaacatgctcatggaatgtccaccttcttctgattcctttttttgtatttgaaaatgcaatggtgtgttccaaattattgttggtgttgttaatgtcatgactctcctttgaatagaataaaataaccccttttgttttgtgttttctactgaattagattttcctctagtcctatgtgaataaaaagctatttgaaataaaagtg

SEQ ID NO: 737123 - DNA, 606 bp, Homo sapiens
ggacgcgtgggtcggacgcgtgggtcgacccacgcgtccgggtgagcagggcaggcaggaaaccaatatttagtacttttgtgattaaacattctagaccaggcttgttgatatgtatgccaatagcctagaatttttggcttagtgtaaaataaaaatgtcttttctattgtggtctgatatccgtttctgtaataagatcagtttgttgtcctctgtgcaccagtggttttgcccttaattttttttggctagcatcaccaagatctgtcatccagagctgctgagaaaaatacatgttgccaaacttttcttaaaattgtgctgccagtggtattttcccagatgtgaaaaataataatctaataaaggattaatatctaataacaataccattgttgaacatgctcatggaatgtccaccttcttctgattcctttttttgtatttgaaaatgcaatggtgtgttccaaattattgttggtgttgttaatgtcatgactctcctttgaatagaataaaataaccccttttgttttgtgttttctactgaattagattttcctctagtcctatgtgaataaaaagctatttgaaataaaagtg

SEQ ID NO: 737124 - DNA, 2807 bp, Homo sapiens
cgtctggctaatttttgtatttttagtagagacggggtttctccatgttggtcaggctggtctcaaactcccgacctcaggtgatccgcccgcctcggcctcccaaagtgctgaaattacaggtgtgagccactgcacccggccaaacttattgttttaatcccagcatttatgtttagaagaattaatttaaatatttcttactatttctctgtcgaatgtttactctcatcttatctcaatgaaagaagtattaaaagtcttatggccccaaaagaaacaagccaaactgtactgtcttaaaagtgattcattctgagcttgaaacgactctgtcagtgtttgacattgtcatttctagtggcatgtatcttaacattcttttcctgcttcaggaatgaaatcacttgtcctgctgagaaaataaggggaaaacaagatagaagtaaaaaacaacacacctgttgaactattttcataaagatggcgttttcactttcaaaagaaatgaaaaccagatggtctatgctaagaagtgaaggcattttgttgtcttcagaactgatcaacatggtcatgatcatcatcaaatttcttgtttccaaaggccactattgtagtacagtctccagcaggattttgtaccatgtgctgcctttggaataaagtattataatgtatcttgtcaccttcatcaacaccaccattaaatatgtaagttcctatatgtgactttttctgggcatatttgcatcaaaaatcacagtccttgcctccttgcttgcttttactccatgaaacgcttcatgaagcagagcatgattgtcaagtgaccagaggatgacatttgtaagtgaacgtgggtatactcacacatgctatactcatactacataacttagtttctccaaatcaactgcagtccgttttatctatgatattcctggcttcgtataatggttttgtaaaatacattaaatacaattaagtccgttattactatgctggaaataactaggtcagacaatgaaaccttagacttttgattggggctgtttggacttgatccaatgataaggtaataaggttgttgcaatttctcaaagcatcttaattctcaaactgaaacatttagcaaatacatggtgaatctggtgtaaacttacaatctaacaaataattttctttcaactcttctctttttctgcctaacaatctatacgaaattgccaatatctaagcaatcaaaagtttctgaaatctctgtttccttagtagaaatgaccttgacaacttattttctgagataccactaggcctactgtctttcatgccattttatataaacattttgatagatactctgtcttttgttttttatctcttctcttttcaagagtcacttgactttttcaaatattcttaaaagatagatttagttattgtattttggtctacaattttggacttggcagtttgttttactaatgcagaattattctttttgtttcaaacatagtttgccatcatctggctactacctaatcatgttgtactagttattgtggaaagaaaattgtacatacatttccttgtcctttgggagatgtctttgagtcaaacccacaagcatgaactctcacctgaaagaaaactggaaaaggagaaactttaaatcagtatgttttgaaaggaagagatttccagactttttaaagcaaattggaatcgttttatttttttgtttgggccttaggcacaatagaagcaaatgttgcaatattaaatataatagggagagttcactgtttcctgggacattgtggtcatgtccttaatccttcattgtgatgccccttcttggagttggcattttgtgacaattcatagagatcttgcagcaatatttggctattggttttattaacttaaaattcaacagaaatggagtaattaaaaaaaaaaaacaaaaaacagagaagaattgcaaaatctgaagtggaatggcacttccttgggtatgtaagggttgtttttagataaaactcccgatttgttcttcctacactttaatagtctcaaattctttctggggaagcaacgtcagtgtctacctccacagtaactatgatataggaaattgtcctttcagtggtttctaggtataacaaacaagccgttaaaaatgagtgaccattttgtaggttacagcctcagcaatctgtgtcatttgaaagcaaatatcctgatatttttaaataaggtgagcagggcaggcaggaaaccaatatttagtacttttgtgattaaacattctagaccaggcttgttgatatgtatgccaatagcctagaatttttggcttagtgtaaaataaaaatgtcttttctattgtggtctgatatccgtttctgtaataagatcagtttgttgtcctctgtgcaccagtggttttgcccttaattttttttggctagcatcaccaagatctgtcatccagagctgctgagaaaaatacatgttgccaaacttttcttaaaattgtgctgccagtggtattttcccagatgtgaaaaataataatctaataaaggattaatatctaataacaataccattgttgaacatgctcatggaatgtccaccttcttctgattcctttttttgtatttgaaaatgcaatggtgtgttccaaattatgactctcctttgaatagaataaaataaccccttttgttttgtgttttctactgaattagattttcctctagtcctatgtgaataaaaagctatttgaaataaaagtg

SEQ ID NO: 737125 - DNA, 837 bp, Homo sapiens
  misc_feature (829)..(829): n is a, c, g, or t
gctttattcatgtgttagtcaagatcgagtgaagtaagaataaaacactctagataaattgaacaggaaaggatcgaatatagggaattacctgcttacacactgttcgagaaatttgggagtcaaagtcaaggatacttttgttggtatcaagaactcagaaagtgcagcaaaggcaagaaatgactacctaatatcttagcaacctagaacacttaatggggtcattctcaggaagatgcttggaagacaccaacaaaacactacatatatattaatgcccaaacgtccgactccagctgctgccagtgaataatgtcttctctttctcttcccctaccaggtttctgtcagtgatggtcattggcagaatatgaatgcaaaccctactgctaaagagagctggggaaatgtttccagactttcagccctagtgatactggggagagttttgaagggcaaggacagaactgaatacaagagatgctgtcctgcttactcagcttaattcctttccttcaaaacaaaaacaaaagcacttgcttctcagaaggattctgttaatctatttatttacaccaaggtattatggaccaacaataccttcaaatgcatttttttcccccaggacaatttgtactttcacaagaacaaagatttgatttaaagaagcgaatccatctaattgacaactggttggaacagggactcactgacaacactgtttcctgaggggtcctcagagatacaaagacattttagacagaaatctactcttcaggattttaatctatttagccttttctttgtatgtgcaaagatatttggntttgttga

SEQ ID NO: 737126 - DNA, 974 bp, Homo sapiens
ccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactttccaacaaatcatattccgttcagggccaaagtgttatgatgataagtccatcaagtgaatctcaccaacaagttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttctaacaacagcagtgatgacagatttaccagtgatttccaatatactttcaagattgtttgaaagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccga

SEQ ID NO: 737127 - DNA, 2566 bp, Homo sapiens
aacagatgagtttcgaactaaatcaaatgagagcaaatggaaacaccacatctaataagaacagtgcagcaatggatgcagagattgtgttaagatctcttatggattttttggacaaaacattaagtctctcagcaaaaatctgtgagaaaacagtcctaaagcgagttttaaaagagttatggaagctagttctcaacaaaatagaaaaacaaattgttcttcctcctctgacagatcaaacaggaccccagatgattttcattgcagctaaagatcttggacaattatccaaactgaaggagcacatgattcgagaggatgccaggggtctgacgccaagacaatgcgctataatggaggtagtcctggctaccatcaagcaatactttcatgcaggaggaaatggcctgaaaaagaatttcttggagaaaagcccagatcttcagtctctgagatatgctctcagtctttatacccaaactactgatgccttgataaagaaattcatagatactcaaacctcacagagtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcggccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtaaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacatgc

SEQ ID NO: 737128 - DNA, 2232 bp, Homo sapiens
gtaagcagagatggacagtatattcaagaaatctgattaagataacacctaaagaagagaaggtccatccataggttggctgagttcttatttctgaaataatctctggaggaacttttaagaatcctgaaagattcaactattttaaactcttctggaaaagtatatgcatatactcctttgaaacccctatgattgtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcggccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtaaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacatgc

SEQ ID NO: 737129 - DNA, 2135 bp, Homo sapiens
cggtccggaattctcgggataaattcagcaatttgttcatgatagctgcttggcggggtggataatatcctggtcaaaatgactgagccacatcagtgatgtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcggccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtaaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacatgc

SEQ ID NO: 737130 - DNA, 2148 bp, Homo sapiens
caacactgttcagtgactcactcacatgctcacaaattcagcaatttgttcatgatagctgcttggcggggtggataatatcctggtcaaaatgactgagccacatcagtgatgtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcggccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtaaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacatgc

SEQ ID NO: 737131 - DNA, 760 bp, Homo sapiens
tcactaattgaataaatattcttcacagataccatttctctgtctccataatctacaaatgttacattgacatgctccacagactgtatcccactaataagtgctctggaccactgtctgtttactgttcgcttagccaaacaagcaagggtgtttctctggtgaggagcagctgtatttttgcaatagtactgaatatcagacattagagttttaagtccttgtatgttcctggtcagctgacaccagaaatagccagggttttcaacataagacactctgacttctactgtacttccaacttccagctctcctttactagaggagcctggcttaatttccaagcaattctgcataagaggaaaataaacagatgctcttttcactttttcctgcacaactagttcagttgaaccatttgttacaactgttgtgtcactcaaagcttttgaaacagatgtggttttattctctctcttggctttctgctctccttctccagtcttggcaaaaggtattttgttactctccgtagtaaagtggtttgaaacatgccctggggagtgggcatttaccaggatattttcctttgtttcaaattcctgatacttggcatatccagcttgggcaattaccttactaatgttttcttcccctgttcttgattcgtcaagaatctcaataacatattgatgatcctgtttatcaagaatatggatgactaattctttgtggagcacagtctttttaaaaaaggaaa

SEQ ID NO: 737132 - DNA, 2794 bp, Homo sapiens
  misc_feature (103)..(103): n is a, c, g, or t
tacagggcatatcattaacaaattgtttgagaaaacccgaaaagttagtgctcacattaaagatgtgaaagcccgggtggagaagcaacaaattcatgttaanaaagttgaagtcaagcaagaggaaataatgaagaaaaacaaattccgcgtggtaatattccaggagaagtttcggtgtccgacatccctgtctgttgttaaagacagaaacctaactgagaaccaagaagaggatgatgatgatatctttgatcccccagtagatctgtcttcggatgaagaatattatgttgaagaaagcagatctgccaggcttaggaagtcaggcaaggagcacattgataatatcaagaaggcattttccaaagaaaacatgcagaagacacggcagaatcttgacaagaaagtgaacagaattagaactagaatagtgaccccggagaggagagagaggctaaggcagtcaggagagaggctgagacagtcaggggagaggctgagacagtcaggggagaggtttaagaaatctatttctaatgcagctccctcaaaggaagcttttaagatgcgcagcctcaggaaaggtaaggaccgaacagtggctgaaggtgaggaatgtgccagggagatgggtgtggacatcattgccaggagcgagtctctgggccccatcagtgagctctactctgatgagctcagtgaaccagaacacgaggcagccaggccggtgtatcctccccatgaaggaagggaaatccccacccccgagcctttaaaagttacttttaaatctcaggtgaaagtagaggatgatgaatctcttttgttagatttaaagcactcatcgtaaagaggaattaagtatatcctaaatatgaatctcctaatcatgcagttttagtttgaatagtgtagtcgtctacatttctgtgccatgtaggaaaacataaatgtattttttttcttatatttaaaatcttgaagataatataaatattattatcactctttctcatggcagctgtggattttttagttcctttctcttgtccaccagaaaaatagtttcctaggttgggccagttacgtgtttggtaagggcaactttgcggccgtcatttgcaggagaactctaaatattggttaggattaatattgtggccagcctcaaaggggaataactcatgtgtgggttatatcgtccagatgttcagatcaacagatttgttagtaaattagcagtcacaccccttttttgatgctttcacattaaaaaattgaagttttggacttgagcatttggctctagtatcatagctttacttataagaaaaccctgggcaagtcatctgcttattctcatcagtaaaaatggagagggttggcctctgctgcctgcctcagaggactgttgtgatgatcaaaggaaatggtacacattctgggggaacaagaagcacacccagagaaaacaagcctcatcagttcctccaaaacagaatggaaagagttacaccttctgaaaaagccctcagcaccaatcaataaggtcctaggttggagagaaactaaagctggtcttcagaagccttttcacagaatcaagagtgaaaaataagtaaatgtttgggtgaccactttttcatcagactaactatatcttgggttttagttgggtctcaaaatgttccccagccagaccctttctaatttccttttgattaagatctttggtggactatagcactaaatttgtttaagcagtatgaggcataaaattgtgactatgtttctaaagtcggccctgatgcattgggtttggaaatgaccacaaatattcctgttttcctgagtgtacccttcagggtccagctgtccaaaacagtgttgataggagttcatcatagctgctttgggaggaagccagattctccttatcttttagctttagatcgtggaatccaggaagtagaacaatgtctattgttgctaaagaaagaaagaaatgggccgggtgtggtggctcacggggagtaatcccagcactttgcgaggccgaggtgggtgaatcacctgaggtcagaagttcacgaccagcctgaccaacatggcgaaaccctgactctactgaaaatacaaaaattagctgggcatggtgcatgcgcctgtcccagctactcaggaggctgagacaggagaattgcctgaacccaggaggcggaggttgcagtgagccgagattgtgccactgcactcaagcctgggcaaaagagccagactctgtttcaaaaaaaaagaaaaaaagaaaagaaagaaatggtagtactgattctgtacttgaaggatgtttaatgtagcatggtgttgtaatagagaagaaatgatgaaattgttgaatttgaagagttgggacaacgatcagctatcccactttttttctcactttcagatcagtttttggataatcatatggtagttaaaataataagtgtacacatatacacacaggcatacataaatcggctttaaaatatttgactcagttactcagatgtttgggtttgggagtctgattcagcatcatttcctcttcaccttgcatgaatacatgaaatcataatatcgttcatgttgttacctttttatattgaaaactaaagtgtatacaacattggataacactttcaaatgaataattttaaaatgtttttatgacattttggaaagatcttgggtgcctaatcacatattttcttaagaaccataataaatttgaatttaagaaaatgtt

SEQ ID NO: 737133 - DNA, 584 bp, Homo sapiens
ggctcactgcaacctccacctcccaggttcaagatattctcctgcactcaagcctgggcaaaagagccagactctgtttcaaaaaaaaagaaaaaaagaaaagaaagaaatggtagtactgattctgtacttgaaggatgtttaatgtagcatggtgttgtaatagagaagaaatgatgaaattgttgaatttgaagagttgggacaacgatcagctatcccactttttttctcactttcagatcagtttttggataatcatatggtagttaaaataataagtgtacacatatacacacaggcatacataaatcggctttaaaatatttgactcagttactcagatgtttgggtttgggagtctgattcagcatcatttcctcttcaccttgcatgaatacatgaaatcataatatcgttcatgttgttacctttttatattgaaaactaaagtgtatacaacattggataacactttcaaatgaataattttaaaatgtttttatgacattttggaaagatcttgggtgcctaatcacatattttcttaagaaccataataaatttgaatttaagaaaatgtt

SEQ ID NO: 737134 - DNA, 703 bp, Homo sapiens
tcggtaccgaccactcctatagatcagtctaattacatttagtcaggtggatttatttgatcacctcttaaaaatggcatcttcctggcaaactagaattctgttctgtgcatctgctgagttgacattcagtgtctgctggtaatggaaatagagtaattcttagttactgtagtcttcagctaatcatttccttcataaagtttaaactgactggaatttttcagcaacgtggatggatttggactggaagcagaagcccgcatgaccacatggcacattatgatcccctcggacattgaaccagatggtagttacagccaagatattagtgaagggcgtcagcttctcataaaagctgtcaacagagtttggactgaactgatacatagtaagaaacaagtcttagaggaacttttcaaagtaactctacctgtgaatgaaaggggccacgtggacatagctacagcaaggccactcattgaagaagctgccctgaagtgctggcagaatcatttggcccatgaaaagaaatgcataagtcgaggagaagctttagcgcccaccacacagtccaaattatcccgtgtcagcagtggctttggtctttccaagttaacaggatcaagaaggaatcgaaaagaaagtggtcttaataaacacagtctttccacccaggtacttttttagtttcattgctgat

SEQ ID NO: 737135 - DNA, 367 bp, Homo sapiens
gtcagagtctaatgtgattaccgtatctttccacttgattttactaggtgactgaccttgatgatgaagttggatctccagcagaagagtttaaagcgtttgcagcagacacagggatgaacaggagccaatcagagtactgcaatgtgggcaccaagacatatctgaccaatcacccggctaaaaagttcgtttttgacttcatgcgggtcttaatcatagacaacctctgtctcactcctgccagcaagcaaactccactaattgatcttttgttggaggtaaagaaaaagaaacgcatttacatctcttttgcattactttttaaattagaacattagtaaccaaacaagttctataacaagga

SEQ ID NO: 737136 - DNA, 1520 bp, Homo sapiens
gcagtttgatttggattccatttggacattcatctttggagttcctgcctccagcggaactgtggtctcttctatccataacgtatgcacagaagctgtttttttattattgggaatgctccgcagcatgctgacttcaccttggcaatcagaagaagagggatcttggctccgagaatatcctgtgaccctgatgcagttcttcagatatttgtatcacaacgtgccagaccttgcctccatgtggatgagccctgacttcctgtgtgcattagcagccaccgtcttccccttcaatattcgcccttactcagagatggtgactgaccttgatgatgaagttggatctccagcagaagagtttaaagcgtttgcagcagacacagggatgaacaggagccaatcagagtactgcaatgtgggcaccaagacatatctgaccaatcacccggctaaaaagttcgtttttgacttcatgcgggtcttaatcatagacaacctctgtctcactcctgccagcaagcaaactccactaattgatcttttgttggaggcttcccctgaaaggtctacaagaactcagcaaaaagaatttcaaacttacattttggatagcgtgatggaccatttgcttgcagctgatgtgttattaggggaagatgcatctctgcctattaccagtggaggaagctaccaggtattggtgaacaatgtgttttatttcacacagcgtgtggtggacaagctttggcaaggcatgttcaacaaagaatctaaacttcttatagattttataattcaactaattgcacagtcaaagagaagatcacagggattgtcactggatgcagtgtatcattgcctcaataggaccatcttgtaccagttctcacgggcacacaaaaccgttcctcagcaagtagctctgcttgattcactcagggtcctcactgtaaacagaaacttgatcctgggacctgggaaccatgaccaagaattcattagctgtctggcccactgcttgataaatctacatgttggaagcaacgtggatggatttggactggaagcagaagcccgcatgaccacatggcacattatgatcccctcggacattgaaccagatggtagttacagccaagatattagtgaagggcgtcagcttctcataaaagctgtcaacagagtttggactgaactgatacatagtaagaaacaagtcttagaggaacttttcaaagtaactctacctgtgaatgaaaggggccacgtggacatagctacagcaaggccactcattgaagaagctgccctgaagtgctggcagaatcatttggcccatgaaaagaaatgcataagtcgaggagaagctttagcgcccaccacacagtccaaattatcccgtgtcagcagtggctttggtctttccaagttaacaggatcaagaaggaatcgaaaagaaagtggtcttaataaacacagtctttccacccaggtacttttttagtttcattgctgat

SEQ ID NO: 737137 - DNA, 721 bp, Homo sapiens
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaacaaaaaacaaaaaaaaaaacaaaccaattcccctatagggaagtcgtttacaataactggcccgcgttttacaactccggactgggactctgctttaccccaataatcgcttggagtcccctttccagtggggtattacgagaggccgacccattcgcttccaacatgggcgctg

SEQ ID NO: 737138 - DNA, 595 bp, Homo sapiens
gcggccgcctactactactaaatttgcggccgctcgaccggcggagggcaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaacacaacaccctacaactccccatgcacatatccgtatcacctacacaatacaacaccacaacaggcggg

SEQ ID NO: 737139 - DNA, 720 bp, Homo sapiens
  misc_feature (1)..(1): n is a, c, g, or t
nattcggcatgaggccagtgcgcgcggagggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcagcttcgcgaattccacgtgctaggccaaggtcagggacacagatggtgccacccggtgcaggtctctccgctcatcaagctcggccgctactccgccctgttccctcggggtggcctaacggagccacgcgctagaattacctaaaagctcgggcagaagagggagaggaggataggagcagaaagagaaagaagaaagcaggatgaactgaaggggatcgccagagagttggcagaagatgacagcatataaagtgagtgacctggaccatcttggacagcagcggatgatag

SEQ ID NO: 737140 - DNA, 527 bp, Homo sapiens
gtgatgctgcggtcgctctgaggatccgagtccattcttgtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttggccctttgtgctgaacaccaaatcaacctaattaaggttgatgacaacaagaaactaggagaatgggtaggcctttgtaaaattgacagagaggggaaaccccgtaaagtggttggttgcagttgtgtagtagctcaggccaaggatgtcattgaagagtatttcaaatgcaagaatggacgtctatgcaagaatggacgtctatgcgagaatggacgtct

SEQ ID NO: 737141 - DNA, 827 bp, Homo sapiens
  misc_feature (553)..(554): n is a, c, g, or t
ggcctgggtggcgattccagacgaggggtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaacaaaaaaaaaaaaaaaaaanngggggggggggcaaaaaaacccccggggggcgcccatgtatggctacccccggtttttgttgaaaaagggcgccccaagaagggagaccatattatagaagaggcaggggccggagttaaacacacgtcgctgggggaaaagcggcgcggggacttgtggagaagacccacttctggggggtgaatatgtgcacgcaccaagagtatagggcgggagataaattgggtgctgtgtaaccacggtaatttggcggaaaagtcccgggttgtaaa

SEQ ID NO: 737142 - DNA, 725 bp, Homo sapiens
ctggaccggtccggaattctcgggatgtgcggcgctgaaccgcccatgccgcgctcatgaccagaacgagaaacagcgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaatatttctttctcttcctcctctctttccctcttcttcttctctttcccacccctaattaatgggccgtctttaaacacgcggcatgggaaatccctgggcttccccaacttatcaccttggatctctacccttttccccaggtgggcct

SEQ ID NO: 737143 - DNA, 958 bp, Homo sapiens
  misc_feature (23)..(23): n is a, c, g, or t
  misc_feature (26)..(28): n is a, c, g, or t
  misc_feature (31)..(32): n is a, c, g, or t
  misc_feature (37)..(38): n is a, c, g, or t
  misc_feature (40)..(40): n is a, c, g, or t
  misc_feature (574)..(574): n is a, c, g, or t
gaccggtcggattctccgaatcntcnnncanncgtcnncnacgcgtccggtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaaaaaaaaaaaacccgggggnttttttgtggggggggggaaaaggggtttggaatgggcctggtgcatagggtttcggacccgttttttggtcaagggggaaatcggggggaccccccaaaagggaggcgaataaattcgaataagccggttaaccgggtaaacgcgcgggaaagcccgcgggatattacccggctaatgaaggggctaatttgtgacaccaagacctcctttgaaaaccatccacgggaggaaccgcgggtcacacaagaatccgcgctacagggggtgtagctgcgcggcaccgaggctcaactctttcacggatagcggctgcagcgcatcacaaactgctagtacggagagggccatctaactgtccaggatatacgcgacaggcacggcg

SEQ ID NO: 737144 - DNA, 849 bp, Homo sapiens
cggacgcgttgggcggacgcgtggcgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaaaaaaaaaaaaaaaaaaaaaaatgacaaaaaaacaacaccggggggacatatgggggggggggcacaagcgtgacaaaagggccaggcgcaccaagaggacgagaccccacttaggcacacagcgggggaaaccgaggagcgccccaaaaagagagcggaacaaattagagaaacccgaggcacctataatttcctctgcagcacatacaaaaaaaaaaaggaggtaagagggggagtaacaatgggtaaaaagaagggataaaaagaaataatatattagaaataaattatatagtaaatcaaaagaagt

SEQ ID NO: 737145 - DNA, 668 bp, Homo sapiens
  misc_feature (18)..(18): n is a, c, g, or t
gagagagagagagagagngagagagaggtcgcgcggagggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttggccctttgtgctgaacaccaaatcaacctaattaaggttgatgacaacaagaaactaggagaatgggtaggcctttgtaaaattgacagagaggggaaaccccgtaaagtggttggttgcagttgtgtagtagctcaggccaaggatgtcattgaagagtatttcaaatgcaagaaatgaagaaataaatctttggctcacaaaaaaaaaaaaaaaaaaaaaaaaaaaaccccggggcctcattggccggggggggaaacaaggggtcggaaggggcccggggccaaggggtcccggcccgtttcttggccaagggggaaaccggcgggcccccaaagggagcggtataatcggaaaaccgggtaccgcgtaa

SEQ ID NO: 737146 - DNA, 1306 bp, Homo sapiens
  misc_feature (23)..(23): n is a, c, g, or t
  misc_feature (26)..(28): n is a, c, g, or t
  misc_feature (31)..(32): n is a, c, g, or t
  misc_feature (37)..(38): n is a, c, g, or t
  misc_feature (40)..(40): n is a, c, g, or t
gaccggtcggattctccgaatcntcnnncanncgtcnncnacgcgtccggtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaagaaaaaaaacaaaaaaaaaaaaaaaaaaaaaaaaaaaaaaaagcagggggggggggaaaggacccagggcggggggggcaaaaaccaagaagccacccgggagaggagcgagcggcgagacagggcgggcagaggaacaaggacgaggccgcagcaggcgcacgggagaacgcagcggaaccaacccagcgagcccaaggaggcaacagggacgaacgaagatgggggcacagcacgacgcaaggaaggaggagcgggcgagacggagaacacggaggggtccagcgccgaggacaaggagggcggaacgcacggaagagagacagggggagcggcggggcgaaaggagcggagcagaaagcgggccgggggggggagggaagccggggacgacatgcggggcggcggccgcgccacgcgggagagagagagggggagcagggccgacgaacaagggagtcgccgacgaacgagcgcggcaccggggcggcgacaagcacaccggagcagccgaggcggcggagagaggataggggaggggacagggaaagggcgagcaggcaaccgaccaacgacgaaggcaccaagcagagccggggcaaggaggaaggagaggcggggggagaagcgacgcggggggagcggcgagggaagcaggcaaca

SEQ ID NO: 737147 - DNA, 333 bp, Homo sapiens
aagcggcctggctgtattcactcgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggccccggtagcccgaagctgtgagggtcctctagacacc

SEQ ID NO: 737148 - DNA, 443 bp, Homo sapiens
  misc_feature (335)..(336): n is a, c, g, or t
gcggccgcctactactactactactgctcgaattcaagcttctaacgatgtacggggacatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgnnaaattggcacagaggggaaaaccccggaagagggtgtgttccatttgtaaaaattaaggctcttggcggggggtcagcccggggtgattttagagattttgcgcgtg

SEQ ID NO: 737149 - DNA, 390 bp, Homo sapiens
gatccctcctaacgagctgcatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggccgcgctcgttacggaggcgctcgttacggagggcgtcgttacggaggcgctcgttacggaggcgctcgttacggagggtgtaaggaggcgtcgttacgga

SEQ ID NO: 737150 - DNA, 825 bp, Homo sapiens
catgtggccgagtaccactggaatgctcgatgccaggcatggctccaactcgtgcacacgccaccatgcccagctagtttttgtactttcagtagaaacggggtttcgccatgttggtctctggctggtctggtactcctgacctcgggtcatctgcccccctcgtcttcccaaagtgctgggattacaggagtgagccatcgtgcccggcctttcacatgtttctttaggtatatgaagctggcttacaagaaagctattatggttgggttttggccagaagttttaaaaatgacttacaccaattcagtgtgtcagggacagaggttttactgaagaccagttgtaggttaattgaagatgtatatgctccctagcaggttcttcagactcaagcaattttgtacgcatttatgtgttcagtggattggctgcttatgtttcgcaagtgttagtgcaaagataaccctcctaaaatgcaagaatgatggatttggatctgagttttagctccattttcattgtaatttgaatttcaggcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaattaagatacgaattttagggcg

SEQ ID NO: 737151 - DNA, 896 bp, Homo sapiens
gctccgcgcagatttaaaacgggttaaccgggctctttgcgaaattatgtgccgtctccccttaagggggggtcccgcgcgcgattttcaccccgctggtgtgaacagaaaagaccggggtcagcggaaaaactgttatggaacaacggggccacttggacgaagccctttcttttgttccgccgccccacaaattagaagggccccgcacgtcttttttgttatgttcactttgtgatgtgttttgtgttgccagaaaaaggaatatttttttttattcaagtaactgcaaataggaaaccagagagggagccccaggctgggacaaatcatggctacccctcccgcaacagaacagggggaggaggtggcccctacaccctttatggtcgattcgggcccccttgctcactctgctgcagcatcctaggggcagggccccaccttcctgggactggggtagtcggtcacccagcctgccatgccccagcccctcttccccacaaagagtatcttgggggaggggatcgtgggcagaacaggaggcaatgaggatgaacatttggcgctggtagcagcagcaatgacggatgtcgaagaatggaacattgaacaaaaaacaacacaactgtccggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagtccttaactactacacaactgcaaccaacc

SEQ ID NO: 737152 - DNA, 400 bp, Homo sapiens
gtcatttgctacagcgtgatagcagccgtatatatgtcaagttggtggaggcccgtgctgaacaccaaatcaacctaattaaggttgatgacaacaagaaactaggagaatgggtaggcctttgtaaaattgacagagaggggaaaccccgtaaagtggttggttgcagttgtgtagtagttaaggtaagtcaccgtttattctagggatgaaggttatgctgggtaatcatataaaaccttgtattgaaataagttgaggatcttataaaaggaaaaaactgattcaacaggtttaaagcattttctgcatttcaggaaaaaaataaaagctgtaatttacaagccagccaatgaatctgggcagagaggggatcctctaggaatcgactatcaccctg

SEQ ID NO: 737153 - DNA, 205 bp, Homo sapiens
acccgggccctactttattcttttgcctaggagaatgggtaggcctttgtaaaattgacagagaggggaaaccccgtaaagtggttggttgcagttgtgtagtagctcaggccaaggatgtcattgaagagtatttcaaatgcaagaaatgaagaaataaatctttggctcacaaaaaaaaaattaatgctgccagtatccggct

SEQ ID NO: 737154 - DNA, 751 bp, Homo sapiens
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaacaaaaaaaaaaaaaaaaaaaaaaaaaaaaaaaaaaaaaaaaacaaaaaaaaaaaaaaacaaaaaaaaaaaaaaaaaaaaaaaaaaaataaaataaaataaattaatttaatcataatcatatttaaaaactctataaaaaaaattattatatatttatttactatacaaatttcctcaattttgcgtttatttataatccgcccg

SEQ ID NO: 737155 - DNA, 858 bp, Homo sapiens
  misc_feature (614)..(614): n is a, c, g, or t
  misc_feature (628)..(628): n is a, c, g, or t
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaacaaaaaaaaaaaaaaaaaaaaaaaaaaaaaaaaaaaaaaaaacaaaaggggggggggggaaaaaaatntcccgggggggggnacagatgttatggagacacccagatgttgctttgaacgaggcggccgcatatagggaggtattataaaggagagagggggcgcgtataaacaggcgcgatgggaaaaagctctgggggatttttgaaggagcccatactgggggggggaaaaggggcaaactaccgagaatagaggcgggaataaactggggtagggtagccgggcatttgcggaaatgccggtttgaat

SEQ ID NO: 737156 - DNA, 599 bp, Homo sapiens
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaacaaaaaaaaaaaaaaaaaagggggggggggcaaaaaatttccctgggggggcc

SEQ ID NO: 737157 - DNA, 580 bp, Homo sapiens
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaagtcgacgcggccgcgaatttagtagtagtaggc

SEQ ID NO: 737158 - DNA, 1623 bp, Homo sapiens
  misc_feature (1489)..(1489): n is a, c, g, or t
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaaaaaaaaaaaacaaaaaaaaaaaaaaaaaaaaaaaaaaaaaaaaaaaaaaaaacaaaaaaaaaaaaaaacaaaaaaaagggggggcccctcaaaaaaatcccccggggggcccaagttaacgcgtacccattttttttggaaaagggggcccctaaagggagcccatttaaaagtaaggcccgggcccccttttaaccactccgggacgggaaaaactgctacttgggaatttttgggaagaaaccttattctgggggggggaaaatttgggaaaaattccctacaaagattaaaagctcaagggaaaataaaaaatttttaagggaaaaaggggtaaaacaaatcgcatttgctggcggcttaaaatttttgctcttcgggatttgatttttgaaaattttatccccgggacccaagggcatcccattggtggggggaatttttaaactccccagtccccagggcctcttttttggggccccctcatccccccaaaaaccgggtcctggtactaaaaacacgcccattcccacatttgttaaaaagggtttacccctcgcttaaaaaaaaaatttcaaaaaaaatctcccccctgaaccccctggaaccattataaaaggaatgcggccccctggggggtcccggctaaacccctggcttaatattgcagctcttaaaaaagaggggcttccacaatattaaggtgcaaatttgctcctcctccaaatttttctccgcaaaataaaaagagcactttttttcttccccccgtgcaatctttcaaatattggggcggttttttgtccccccaaaaaatccctcttacaaggggcattcttttttatatcaacattgtccttggtgatataacccaaaccccgtgcggcaattatatcggggcaaacacccggccccaaaaactctgccncgtcgccgcggctaacaaaacagcaggcggattctaccccacccgaaactgtcgggcacgacgcggtctttccgctatcccaccccccccttcttagaacgcgcccctacctacccctcccctatactccgcgc

SEQ ID NO: 737159 - DNA, 732 bp, Homo sapiens
  misc_feature (623)..(624): n is a, c, g, or t
  misc_feature (627)..(627): n is a, c, g, or t
  misc_feature (629)..(629): n is a, c, g, or t
  misc_feature (641)..(641): n is a, c, g, or t
  misc_feature (644)..(644): n is a, c, g, or t
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaaaaaaaaaaaaaaaaaaacacggggggtcatctataggggggggggggaaaaagggggttatnnaanangggcattgtggncanaagttgttttctttaggccccttttttttggacaaaggggggggaatagggggggccccatagaggaggggcataaatttcggaagct

SEQ ID NO: 737160 - DNA, 1312 bp, Homo sapiens
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaagaaaaaaaacaaaaaaaaaaaaaaaaaaaaaaaaaaaaaaaagcagggggggggggaaaggacccagggcggggggggcaaaaaccaagaagccacccgggagaggagcgagcggcgagacagggcgggcagaggaacaaggacgaggccgcagcaggcgcacgggagaacgcagcggaaccaacccagcgagcccaaggaggcaacagggacgaacgaagatgggggcacagcacgacgcaaggaaggaggagcgggcgagacggagaacacggaggggtccagcgccgaggacaaggagggcggaacgcacggaagagagacagggggagcggcggggcgaaaggagcggagcagaaagcgggccgggggggggagggaagccggggacgacatgcggggcggcggccgcgccacgcgggagagagagagggggagcagggccgacgaacaagggagtcgccgacgaacgagcgcggcaccggggcggcgacaagcacaccggagcagccgaggcggcggagagaggataggggaggggacagggaaagggcgagcaggcaaccgaccaacgacgaaggcaccaagcagagccggggcaaggaggaaggagaggcggggggagaagcgacgcggggggagcggcgagggaagcaggcaaca

SEQ ID NO: 737161 - DNA, 1294 bp, Homo sapiens
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaagaaaaaaaacaaaaaaaaaaaaaaaaaaaaaaaaaaaaaaaagcagggggggggggaaaggacccagggcggggggggcaaaaaccaagaagccacccgggagaggagcgagcggcgagacagggcgggcagaggaacaaggacgaggccgcagcaggcgcacgggagaacgcagcggaaccaacccagcgagcccaaggaggcaacagggacgaacgaagatgggggcacagcacgacgcaaggaaggaggagcgggcgagacggagaacacggaggggtccagcgccgaggacaaggagggcggaacgcacggaagagagacagggggagcggcggggcgaaaggagcggagcagaaagcgggccgggggggggagggaagccggggacgacatgcggggcggcggccgcgccacgcgggagagagagagggggagcagggccgacgaacaagggagtcgccgacgaacgagcgcggcaccggggcggcgacaagcacaccggagcagccgaggcggcggagagaggataggggaggggacagggaaagggcgagcaggcaaccgaccaacgacgaaggcaccaagcagagccggggcaaggaggaaggagaggcggggggagaagcgacgcggggggagcggcgagggaagcaggcaaca

SEQ ID NO: 737162 - DNA, 736 bp, Homo sapiens
  misc_feature (590)..(590): n is a, c, g, or t
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaaaaaaaaaaaaaaaaaaaaaccccgggggnttttttgtggggggggggaaaagggggagaaaaaagggcgccgggcacaagaggaccggggcccagtttccggacaccacggggaaacatcagaggagccccataggaggcgggacataatcgcgaaagcccggtacccggataag

SEQ ID NO: 737163 - DNA, 576 bp, Homo sapiens
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaattctactgcattctatgtgtcggtaccggc

SEQ ID NO: 737164 - DNA, 557 bp, Homo sapiens
  misc_feature (533)..(533): n is a, c, g, or t
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcttcatttcttgcatttgaagtcgacgggccgcnaatttagtagtagtaggcggccgc

SEQ ID NO: 737165 - DNA, 492 bp, Homo sapiens
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtgctgacgcttggtaccgagctcga

SEQ ID NO: 737166 - DNA, 2041 bp, Homo sapiens
  misc_feature (1907)..(1907): n is a, c, g, or t
aagcggaaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggtaagtcaccgtttattctagggatgaaggttatgctgggtaatcatataaaaccttgtattgaaataagttgaggatcttataaaaggaaaaaactgattcaacaggtttaaagcattttctgcatttcaggaaaaaaataaaagctgtaatttacaagccagccaatgaatctgcttacctgattgtgtttgtgcagacatactttaaaaactggcaatagtaaagccatgttacgagccttaaggacattgaagtcgttaaggtccctgagaatggctataacaaatcttagtgatgggaaacatttttataagacatagctaattgttgaagctccactataattgatactaatagcttggtgaaattcctaaatattaacaagaaattgcatgcgtgttttgttttttttaaggactatggcaaggagtctcaggccaaggatgtcattgaagagtatttcaaatgcaagaaatgaagaaataaatctttggctcacaaaaaaaaaaaaaaaaaaaaaaaaaaaaaaaaaaacaaaaaaaaaaaaaaaaaaaaaaaaaaaaaaaaaaaaaaaaacaaaaaaaaaaaaaaacaaaaaaaagggggggcccctcaaaaaaatcccccggggggcccaagttaacgcgtacccattttttttggaaaagggggcccctaaagggagcccatttaaaagtaaggcccgggcccccttttaaccactccgggacgggaaaaactgctacttgggaatttttgggaagaaaccttattctgggggggggaaaatttgggaaaaattccctacaaagattaaaagctcaagggaaaataaaaaatttttaagggaaaaaggggtaaaacaaatcgcatttgctggcggcttaaaatttttgctcttcgggatttgatttttgaaaattttatccccgggacccaagggcatcccattggtggggggaatttttaaactccccagtccccagggcctcttttttggggccccctcatccccccaaaaaccgggtcctggtactaaaaacacgcccattcccacatttgttaaaaagggtttacccctcgcttaaaaaaaaaatttcaaaaaaaatctcccccctgaaccccctggaaccattataaaaggaatgcggccccctggggggtcccggctaaacccctggcttaatattgcagctcttaaaaaagaggggcttccacaatattaaggtgcaaatttgctcctcctccaaatttttctccgcaaaataaaaagagcactttttttcttccccccgtgcaatctttcaaatattggggcggttttttgtccccccaaaaaatccctcttacaaggggcattcttttttatatcaacattgtccttggtgatataacccaaaccccgtgcggcaattatatcggggcaaacacccggccccaaaaactctgccncgtcgccgcggctaacaaaacagcaggcggattctaccccacccgaaactgtcgggcacgacgcggtctttccgctatcccaccccccccttcttagaacgcgcccctacctacccctcccctatactccgcgc

SEQ ID NO: 737167 - DNA, 503 bp, Homo sapiens
ccactacactgttcccctcctttccgattcttgtttaaagagaaaccttgtttaattcttcttccagtatattttccagcttgtacactgcatattgggaaagtttggtgtgagtctccctctatcttttgttctacttgctgctccagtggggaaagttaactgtgattttatttcccgtttatttgtaaatgtccatctaatttatatgactttgaatgtaacttaacgtcttttcccactcttcctttttaattaaggatacagaaattgttgatttagattcagacggtcctggtacttcatctggaagaagggtgagtaaataagtgaactgctgaggagatatgttttcaggtttcctgtgtcagtgatccctaagaccaaccccatatttggagaattgctagaaggattcttgcaactaagtatattaggtatgctcattgataatatttattagagtgatgcagtaagggtacccagttgagtcatgggtgaaa

SEQ ID NO: 737168 - DNA, 500 bp, Homo sapiens; identical to SEQ ID NO: 219780

SEQ ID NO: 737169 - DNA, 2408 bp, Homo sapiens
gtctgtaatgatgatgcttaatattggtctaggcatgtttatacctttttttaaaatataaaactagttaagactatataatttctgccttctcagatctatagcatgatgctgcgattatctgccttatttgaaagtcatatcaaaaatatcatctctgaatataagtcagcaatccagagtcagaagaggagaaggccacggtacagaaaacgtctaagaagcagcagcagttcattatctagtagtggagcacctaggtatcattacattgatgcaacattttttgttctcaaagcattttgtatgtattacctaatttgtgaaagtttatgaataatttggggagatcccaagaggtctttttttgtttgtttcctaaactcttatgcctatgtagagttagtaatcaaaagtactatttatgtgggttttactatcccagaaactttttttaaattttaatgattgaagtttcactgtcaaattatctatttcatgaattttagggcatttcttctttggccagctaatacctgaccttgatacctctttgtatcatactgtctatcataatatgttgctaacagaaaaaaaaaaatgctcgttgttacatatttttacttctagtccaaaagggaagcagaaacaaatgaagttgcagcctaaaaatgaccagaatacctcagtatctcatgccaggactagctctcctttctcatctcctgtttcagatgctgctgaagggctttcactatatctacttgatgatgagccagatgggccattttcttcatcgagcttcggtggatatagccgaagtggaaatagccatgacccagggaaagccaaatcatttcggaatagagttttgccagttaaacaagatcactcccttgatggaccccttacaaatggtgatggcagagagccccggacaggaatcaagagaaaactacttagtgcatcagaagaagatgaaaacatgggaggagaagataaagagaaaaaagaaacaaaagagaaatctcatttatccacctcagagagtggagagttaggatccagtttaagttctgaaagtacctgtggttctgactctgactctgaatcaacttccagaacagatcaagattacgtagatggagaccatgattatagcaaattcatacaaaccagacctaaaagaaaactcagaaagcaacatggcaatggaaaaagaaattggaagaccagaggcacaggaggaagaggcagatggggaagatggggtagatggagtagaggaggcagaggaagaggaggcaggggacgagggagtcgaggaagaggtggaggtggcactagggggaggggaagagggagaggaggaagaggtgcttctagaggagctaccagagccaaacgagcacgtattgcagatgatgaatttgataccatgttttcaggacgtttcagtagactgcctcgaattaaaacaagaaaccaaggcaggaggactgttttatataatgatgattctgataatgacaattttgtgtccactgaggatcctctgaatcttggtacatccagatcaggcagagtgcgtaaaatgacagaaaaagccagggttagccatctcatgggatggaattattaacagttaataaatttagaataacttaaaaaattcaatggccttctactgcagggaatttaccaggaaatctacaaagcaagttgtgtggggacttctgcttcctttcacattggtgcttttccatttatgccagtatacatttgtttcaagacttttgatctccacacttcatttgttcaaataagccttactcattaggccttaaattaaaagaaattctgcccacacacacacaaacacatacacacacatacacacacacagacacacacgaaacacaacacagacactacagatttactacattaaaggagcattcagcttcttaagagtagcatgacatttttatctcaatagaatagccctcttttgcttttgtatcacagaagtatagcaccttcttacagagttttatatagtttgtttttgccattttgattcctatacccagtaataataacttttgcacaatacaccaatcctaaaggcagctattaaatgtttacagtttctatattgtaagagcgatctggattattttactcttcccaggccaaactttcatgacttgtactgaactgaagtatatatttatactacagttttttggggggtggggggatcttgatatgcttttcattgatttgcataattcacgttaaaggtgagaaagggttggtgccttgtaaatatgtagcagatcttcgtggtgtgttctgatgtgtgcattaactttattaaaaaagaatacttgaggtatcaatct

SEQ ID NO: 737170 - DNA, 2946 bp, Homo sapiens
  misc_feature (2937)..(2938): n is a, c, g, or t
  misc_feature (2940)..(2940): n is a, c, g, or t
  misc_feature (2942)..(2945): n is a, c, g, or t
ttctttccgtgttacagtgttcactgggacaataatgagagagaaaagatgagcccatgggatatggagccaattccagaaggaactgcctttccagatgaagttggtgctggtgttcctgtctcccaggaagaattgactgctttgctatacaaaccccaggaaggagagtggggggctcattccagagacgaagaatgtgaacgggttattcagggcatcaaccaccttctttccctggattttgccagcccttttgctgttccagtggatctcagtgcctaccccttgtattgtactgtagttgcttatccaactgacctcaataccatcaggcggagacttgaaaatcgcttttacaggagaatatcagcattaatgtgggaggtacgctatattgaacataatgccaggactttcaatgagccagacagtcctatagttaaagcagctaaaattgtaactgatgtcttacttcgatttattggggatcagagctgtactgatatactggatacttataataaaattaaagcagaagaacgaaacagtactgatgcagaggaggatacagaaattgttgatttagattcagacggtcctggtacttcatctggaagaagggtcaaatgccgaggcagaagacagtctttaaagtgtaatcctgatgcttggaaaaaacaatgcaaggaactattgagcctcatttatgaacgtgaagactcggagccatttcgacagccagctgatcttctttcttacccaggtcatcaggagcaagagggagaatcctcagagtctgttgttccagaaagacaacaagattcatctctttctgaggattatcaagatgttatagatactcctgtggacttcagcactgtgaaagaaactttggaagcaggaaactatggtagtcctctggaattttataaggatgttcgccaaatattcaacaactccaaagcttatacctctaataaaaagtcaaggatctatagcatgatgctgcgattatctgccttatttgaaagtcatatcaaaaatatcatctctgaatataagtcagcaatccagagtcagaagaggagaaggccacggtacagaaaacgtctaagaagcagcagcagttcattatctagtagtggagcacctagtccaaaagggaagcagaaacaaatgaagttgcagcctaaaaatgaccagaatacctcagtatctcatgccaggactagctctcctttctcatctcctgtttcagatgctgctgaagggctttcactatatctacttgatgatgagccagatgggccattttcttcatcgagcttcggtggatatagccgaagtggaaatagccatgacccagggaaagccaaatcatttcggaatagagttttgccagttaaacaagatcactcccttgatggaccccttacaaatggtgatggcagagagccccggacaggaatcaagagaaaactacttagtgcatcagaagaagatgaaaacatgggaggagaagataaagagaaaaaagaaacaaaagagaaatctcatttatccacctcagagagtggagagttaggatccagtttaagttctgaaagtacctgtggttctgactctgactctgaatcaacttccagaacagatcaagattacgtagatggagaccatgattatagcaaattcatacaaaccagacctaaaagaaaactcagaaagcaacatggcaatggaaaaagaaattggaagaccagaggcacaggaggaagaggcagatggggaagatggggtagatggagtagaggaggcagaggaagaggaggcaggggacgagggagtcgaggaagaggtggaggtggcactagggggaggggaagagggagaggaggaagaggtgcttctagaggagctaccagagccaaacgagcacgtattgcagatgatgaatttgataccatgttttcaggacgtttcagtagactgcctcgaattaaaacaagaaaccaaggcaggaggactgttttatataatgatgattctgataatgacaattttgtgtccactgaggatcctctgaatcttggtacatccagatcaggcagagtgcgtaaaatgacagaaaaagccagggttagccatctcatgggatggaattattaacagttaataaatttagaataacttaaaaaattcaatggccttctactgcagggaatttaccaggaaatctacaaagcaagttgtgtggggacttctgcttcctttcacattggtgcttttccatttatgccagtatacatttgtttcaagacttttgatctccacacttcatttgttcaaataagccttactcattaggccttaaattaaaagaaattctgcccacacacacacaaacacatacacacacatacacacacacagacacacacgaaacacaacacagacactacagatttactacattaaaggagcattcagcttcttaagagtagcatgacatttttatctcaatagaatagccctcttttgcttttgtatcacagaagtatagcaccttcttacagagttttatatagtttgtttttgccattttgattcctatacccagtaataataacttttgcacaatacaccaatcctaaaggcagctattaaatgtttacagtttctatattgtaagagcgatctggattattttactcttcccaggccaaactttcatgacttgtactgaactgaagtatatatttatactacagttttttggggggtggggggatcttgatatgcttttcattgatttgcataattcacgttaaaggtgagaaagggttggtgccttgtaaatatgtagcagatcttcgtggtgtgttctgatgtgtgcattaactttattaaaaaagaatacttgaggtatcaatctcnntngnnnng

SEQ ID NO: 737171 - DNA, 2197 bp, Homo sapiens
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctgcccagtccgaattgactcctgagacctaatcaggcgcatctctatatggccagcattatccctgggctgcctaaatagttcgcgttaaacacaaacaacaacaataaaatctaaataacactcagtcttagtaccattattacaaaagcgtgaggggcgaaaagattaaaaatgaacatcaacttcggtagagatggaaaaagactgcccactccattccaggaaagaaaaaagaaagtgggagaatctgatcacgacgggctgaggtcctgtgagagcaaagcagattccaaaccgcttagggttgctaaatcaagtggtaaaacgtggccccttgcggcgcggtgagattaacggacccggcgggcccagagcctgcctcgggtcctaaagggatccgccccgccgagtcagccacgccttcgtctcccacgcgctgcgcccggccgcccgct

SEQ ID NO: 737172 - DNA, 2060 bp, Homo sapiens
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctcattattacaaaagcgtgaggggcgaaaagattaaaaatgaacatcaacttcggtagagatggaaaaagactgcccactccattccaggaaagaaaaaagaaagtgggagaatctgatcacgacgggctgaggtcctgtgagagcaaagcagattccaaaccgcttagggttgctaaatcaagtggtaaaacgtggccccttgcggcgcggtgagattaacggacccggcgggcccagagcctgcctcgggtcctaaagggatccgccccgccgagtcagccacgccttcgtctcccacgcgctgcgcccggccgcccgct

SEQ ID NO: 737173 - DNA, 1118 bp, Homo sapiens
  misc_feature (981)..(981): n is a, c, g, or t
  misc_feature (990)..(990): n is a, c, g, or t
  misc_feature (999)..(999): n is a, c, g, or t
  misc_feature (1001)..(1001): n is a, c, g, or t
  misc_feature (1057)..(1057): n is a, c, g, or t
aacggacggaagctccattgagccaaataagttgagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaaaactggggggcctttggncttatgggnccagccccnantgttttgatttgcccccattccttttggaacaataaggtaagctcttacacttaangacttggcctccaggaaatggggagttaaaaggccttttttagggggaaaacctcacctcc

SEQ ID NO: 737174 - DNA, 3718 bp, Homo sapiens
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaaaaaacacaaacacaacaaacaaaaaaa

SEQ ID NO: 737175 - DNA, 4040 bp, Homo sapiens
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaaaaaaaaaaaaaaaaaaaaaaagaaaataaaaaaaaacaaaagataaagaaaaaagaacaaaaaaaaaaggcaaaaagaaacaaaaaagaacaacaacagaaaacaaaccgcgaacaacacgacgcaacaaacacaactacatagaaccacaaaaacaaaaatagaaaaaagagagaaggcagacaaacaaactagaaacaaagactaaacacaaaaagaacaaaaagaagggcgtggagcgcgagcaccaaagtagggctcgagacgaccggagacaaagaagcaggagcacaactctaaccgagaacctacacgagctacgctactagcgagcgaactagccacgaga

SEQ ID NO: 737176 - DNA, 3700 bp, Homo sapiens
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgctgggttgaccggatagcgggtttgtgagcgttcctgttcaccgcgagggggtggaagggggaggcgtgtccaaattgttaaaaaaggggggggagatttcagggaggcacctttaagccagagatataagcggaat

SEQ ID NO: 737177 - DNA, 3527 bp, Homo sapiens
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggaccgcagtcacgtgccaccacacccagcccatccttgtacttttagtagagatgggtttcaccacgttggtctcgaactcctgaccccaagcgatccatcccgcctccacctccctaagtgctgggattacatggcatgagtcaccactcccagcattcatgtctgaagattctatagtggatactttatagt

SEQ ID NO: 737178 - DNA, 3177 bp, Homo sapiens
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccagcctgggcacagaagaaaaggc

SEQ ID NO: 737179 - DNA, 3693 bp, Homo sapiens
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttcctcttcttgtagtccatctcccagacttgtgactatggcttttcattcttcaattcatgacgagtgccaaacttgattttctctaggcacagctttctccctctctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaaaaaacacaaacacaacaaacaaaaaaa

SEQ ID NO: 737180 - DNA, 3523 bp, Homo sapiens
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttcctcttcttgtagtccatctcccagacttgtgactatggcttttcattcttcaattcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaaaaaaaaaaaaaaaaaaaaaaagaaaataaaaaaaaacaaaagataaagaaaaaagaacaaaaaaaaaaggcaaaaagaaacaaaaaagaacaacaacagaaaacaaaccgcgaacaacacgacgcaacaaacacaactacatagaaccacaaaaacaaaaatagaaaaaagagagaaggcagacaaacaaactagaaacaaagactaaacacaaaaagaacaaaaagaagggcgtggagcgcgagcaccaaagtagggctcgagacgaccggagacaaagaagcaggagcacaactctaaccgagaacctacacgagctacgctactagcgagcgaactagccacgaga

SEQ ID NO: 737181 - DNA, 3115 bp, Homo sapiens
  misc_feature (2990)..(2990): n is a, c, g, or t
  misc_feature (2998)..(2998): n is a, c, g, or t
  misc_feature (3005)..(3005): n is a, c, g, or t
  misc_feature (3011)..(3011): n is a, c, g, or t
  misc_feature (3013)..(3013): n is a, c, g, or t
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttcctcttcttgtagtccatctcccagacttgtgactatggcttttcattcttcaattggngaggccantgggttnctaggncngttccccgggccgggcttcttcggcgccttggcccaccttttttgccgctttttgggggtggacccgcccccgggccgctcgtctcctactgggagacccgg

SEQ ID NO: 737182 - DNA, 3455 bp, Homo sapiens
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttcctcttcttgtagtccatctcccagacttgtgactatggcttttcattcttcaatttgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaaaaaacacaaacacaacaaacaaaaaaa

SEQ ID NO: 737183 - DNA, 3106 bp, Homo sapiens
  misc_feature (3072)..(3072): n is a, c, g, or t
  misc_feature (3074)..(3074): n is a, c, g, or t
  misc_feature (3078)..(3078): n is a, c, g, or t
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttcctcttcttgtagtccatctcccagggcatgggttcatctccatcctgggagggcactggtttcttggaggttccccgggccgggcttttccgggccctggcccccttttgcctttctctgggggggggcgcgaccggggngncttnccccgggaagacccgggggggggatcaa

SEQ ID NO: 737184 - DNA, 3105 bp, Homo sapiens
  misc_feature (2976)..(2976): n is a, c, g, or t
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttcctcttcttgtagtccatctcccaaattggacatgggttcatctnaacatgagggggcaacgggtttttggaggttccctgggcggggtcttttctggcgtcggcccctttttgcctttctgggggggggacggccggggggcctgctacctgagacccccgggggccttccgc

SEQ ID NO: 737185 - DNA, 3112 bp, Homo sapiens
  misc_feature (2978)..(2978): n is a, c, g, or t
  misc_feature (2986)..(2986): n is a, c, g, or t
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttcctcttcttgtagtccatctcccaagaatgggaatgggttcactctncattctgngcagggccactgattcttagcacagtttccctggccgggcttcctccggcttctggccaaccatttattgcctttattcgggggggaacgcgtaacacggggccgcggtgcacacgggagagcggg

SEQ ID NO: 737186 - DNA, 3603 bp, Homo sapiens
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttagcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaaaaaaaaaaaaaaaaaaaaaaagaaaataaaaaaaaacaaaagataaagaaaaaagaacaaaaaaaaaaggcaaaaagaaacaaaaaagaacaacaacagaaaacaaaccgcgaacaacacgacgcaacaaacacaactacatagaaccacaaaaacaaaaatagaaaaaagagagaaggcagacaaacaaactagaaacaaagactaaacacaaaaagaacaaaaagaagggcgtggagcgcgagcaccaaagtagggctcgagacgaccggagacaaagaagcaggagcacaactctaaccgagaacctacacgagctacgctactagcgagcgaactagccacgaga

SEQ ID NO: 737187 - DNA, 2034 bp, Homo sapiens
ttttttttgaaaagcagttgtgtttaatcaccaaaattattctgaccctaatggaaaggaaataatctaaatttaaaaaggctggggatttttctcctacatttattttagaggcaagtagaggtgaacaaagaaaatggaatccctaagctcagagctcaggccctggtaaaggctccagagagcagaagcccctctcctcttgcccttatgtgaaacgttgctgccctcaggataccagccatcccgctttggaacacggctgccccaggggatgccttcagtctattcctccagaggcttctcactctgccccagaggactggtcctcctcatcctcatcatcagtgtcctgaagaatcctaagtagtttgagctcagagttccagcctgtgctagccataatttctgaaaagttaaaggagatcttcttttgcctggcagcctgggcttctggcacagcgtccactggagcactaatgtccttgttagtgggttctgtttcatacaattcaggactttttacactgtggtggaaatccgcatggtcatagtagttcatctttggtctctccgtggaatcctgtttcgaagtggttcctttttccatctgctgctgctgcttcatgtcactgttctgacctggcagagttctgtaaccatagagacggtcatgaacggtggtaactggatgtttatgtgaagtgctctggatccctggatcactcttggctttctttttagcctcctgtttcttaataggtgttttcaccttcttctgttgctgctgctgctgctgctgccgctgctgctgtttcctgtaaccttctgtcttcaggttatgtaatttcttcaaacgttcaggatatcgcagtgctggtctttccagggtgaggcggtgtatagatagaaacatcttagaagaaatcacactgtcaggtcggttcttttccaagggaagattctttttcatcatggccaattttatcttcatctctggacagagcatggtttgctttccacctggcaaaagttccttcagtagatcctgaggtaacgcttcggattgagcccagagaggtaggaaatctgaactgaattgttcagacaattgcactggggttgggggaggcacgatcatccctggtgttcctactcgtgttcctgcggactgatttccagagagacccagaaatgacttgcttttcactgccgagttctttcttttcttcttcccatgctggctcacatgtatctctgtttcttctgggatccacaatacaaccatatttctaacatcttcagggcagggaagttgcgtctcattcaaattcaacactggaaatttgggaagtctgttagtacagttgatcaaacttttgtcaggtaaacccttcggaggcctgccatgaaatttggagtaaaactttgaactctgagacaataaagaatgggccttagtaaaggtacattctggtaaatgatgagctgcaaagccggaatctaagatgtctaccacggtgagcactgggagtttatcttcagcatccaggggagttttgcaggatgagccgaggattcgaggatggcccctctcaatgcggcggatagttgcccagcattgtgggtgctgacaaacagccaagccacaggtggtttcgtcccactggctctcatctggcaagtccatagctagaaatggtttaggccaaaggccaaccctgcagcattctagtgctctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagaaaaataaagccctcctgggggcttggcca

SEQ ID NO: 737188 - DNA, 2487 bp, Homo sapiens
aacggacggaagctccattgagccaaataagttggtgagaaggttcccgacgcggcgatggcgagaagcagagaaatggacctggggaggggcgtgcggggtgcggtagggttggatggaagccttggcgggccaaaaccactgcggcttcaaaatccggatgcgccggtatttgaggcggaggcggggctgtggggggaggagggaggctatggcgctcagagcactgtgggacactgtaggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcggtgagcagctcggggggggcggacgaacgggcaggagggaagcaggtgctggaacggcagctttgctcacccccggtctcctcgcctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaatttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaacccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaaaaaacacaaacacaacaaacaaaaaaa

SEQ ID NO: 737189 - DNA, 836 bp, Homo sapiens
ttttttttcttgtaaaatgaggtctctttctcaaaccaacaattttgtagttgttaggataaaggaatcaaatataacatctcaagcaaatggaccttcttggacaagttcctggtctcctctttaaatgccaactgggtgctaaggcactgtttaggtgttttgggcacatcatctcactaaatcctcacaccaccacatgtcagtgatggtttctattttacatacagaagttttgggactctaagtaacccatccaggtttaccacagtggaactggggtttaggcttagactcaccgcattccaaatccttgctcttagctttacaccaactatctctacctaatgtcaaaggcacaggctccttattgtgagtcatttcccccatactatatggctttttggtttggctacacagagcactattcctaatcttacttaaaatcaaattgatcaaagtcaaattttaattggaagaaaaaggggtgagtttaacccaagatactcaactttttcatttctaagtcttgcggagtataccccttgctcattaaagtcattaggaagctccctattcagaaactttcatatatggcacacgatttattcctttatctggcaccaccctgtttgaagttacacagacctgatcagaatcttggcatcgcacttaccagctgaggggaccttaggaaagttagttatgctttctgagcctcagtttatttatctacgaaatggaacccctaccttatagacttgctatgagaattaaataagataatatatttagaagccaacacatatttgctgaataaatgactgcctacaacg

SEQ ID NO: 737190 - DNA, 1866 bp, Homo sapiens
tgacgagctcttctcccatcacagccccatgaagaagggggagtcccagatcacaccccctttctctccatttgttggagcaggaaattggcaagaagtagaaaccagtgagcgagcgcactcagggccaagcaatgtgcggctctcccagctgacgccactcgggactgcccaagaccactgagcaataaccacgcctggtctggggtgtccagctcctgggatgcagatggctgaggttggggcacccttgggacagtgctctccagtccaacttgggccaagaaggtggcctggggtccttgctctgcctgcccccacctctactctctactagtcctgtggttgcgcctgtaccatctctgtcccccctcaagtgtgtgtactcactgcacccctattctgtccccctccctttcagaacctgtcttgtgtgtgagggcctcactcctctctcggaggtgcccagaggactgtgggaagaagggcaaagtctctttccagaggagcgtgcacagaccctcatctcccacgaccacacttttggggtgaacagggtgactttgttaggtcgattcttctgcagagatggtgaagtactctatctgcccacccacccactaaaagccatagctccgtccgcctggcctccccccagctctatagcaatagcccccttcccccttccctcctgggcatccagggtgtccagctaggggcccccaccgcactctggtcccagggatcttccagtggcctgcctgcttctcccgaagtgaccccatcagctccacccaactcccatccctcttccagcaaccacagataatgacaattgtttgtgaggtgcttggagatcccctagatgaaaggttctgggtgctggggcagctgactcactgactctcagctgaggtgctggaggtgcctgggaaaggaaataaggcaagctgggggagcacctgtagcagatacagggttccagttttcacagaaattcccctcctcgccctcctggaaataatggaaacccctccacccgcctgcacagaaccctctgtgcagcagaacgagactgggagctggagtgcatggcccgctcttggccacaggggcccaactctcctcagcctcagggccctggagaggccccaccctccctgggtctggcttgagagcccacctggccaaagggaaacctcgcacccccacgcgctcctggcccctggaatatcttggtgactaagaagggaaaggactgcatttctctctcctctgctgcacgaatccccattgggagagagagtgttgaagaggacactcaggtccctaggcggagctcctgccacaccccaagtatggacagctccaggacacagagctgcaggtggggacctccccctgctctggaaatcagccagggagcactgggcagtgcggtttgaggctctgtacccctggcccccacagctcagccacagcaccctctagcttgggggactagtccagggccaaaatgggataacccttccccatataagcagtaggatggcgtcccccctggtggagagaggaaggaggcctagagggtgtggggcagcttcgaagcgcggggagccgggggtctccaagcaccttctcctggacatgccagccttgaatgggggatgtgcagggcttcaaacccacctggcaggagccctgtggcagggcagagggaccctgctccaaattctctgttggctgcgcttttgtatccaatgcttttcagagtgtattcactcacccacagaaatagagccctgtgctttaggggtgactgtcatatgccttattcttaataaaatctctgaaaaacaaaaaaaa

SEQ ID NO: 737191 - DNA, 974 bp, Homo sapiens
  misc_feature (2)..(2): n is a, c, g, or t
  misc_feature (15)..(15): n is a, c, g, or t
cnaacgtaaataatntattgaaattcttgaaaagtgcagagtctcaagggcgaagtgaaatcttaatgagtctacagaaagttctaagtggactgggtggtgcagcagcttcctcccatcgtgatatttacaagaatgccaggtctctcttgactgataggtcaatggctgttcgatgtgcagtggccaagtgtctactagaactacagaatgaagctgtatttatgtggactgctgaactagaaaatatagccactctctgctttaaggctttggaaaactcaaattatggggtacgagtggcagtgtctaaacttttaggaacagtcatggccacagcattaatgccaaaacaggcaacagtaatgcgtcagaatgtgaagcgagcaacatttgatgaagtcttagaactcatggccacaggatttctgcgtggagggtcaggtttcttaaagagcggtggagaaatgttaaaagttggagggtccgttaatcgtgaagtgagagttggagttacgcaggcgtatgttgtttttgtgacaacattgggtggtcagtggttggagcgcagctttgccacgttcctgtcccatgtacttgatctggtttcccatcctcgggcaacacaaacacatgtggaggctgtgtactccagacgatgtgtttcctttatcctaagagctactgtgggcagtttgctaggtgaaaaagcccagattgcagctgccaaagaaatctgccaagctattggaaaacaaatgaaagccgtagaagcagtagtgaatgacacaagtggagaaaacaaatctggcgcagcagacattgcagcaagccagcatgtgatggtctgtgccctccaggaactcgggagcctggtgcagagcttgaatgccaccgcatcccctcttattcaagaagcatctatagggcttttggagattgtgacttcagtgctgcttcatccaagcatggct

SEQ ID NO: 737192 - DNA, 2123 bp, Homo sapiens; identical to SEQ ID NO: 338851

SEQ ID NO: 737193 - DNA, 1417 bp, Homo sapiens
gtgtaatggatttaaatttttaggtatctttgtctactttttcataaaatgaaagaacctggctgggcgcggtgactcatgcctgtaatcccagcacttctgggaggccgagacaggtggatcacgaggtcaggagttcaagactagcctggccaagatgctgaaaccccgtctctactgaaaatacaaaaattagccaggcatggtgtcatgcacctgtcatcccagctacttgggaggctgaggcaggagaatcgcatgaacccgggcagcagagattgcagtgagccaagatcgcaccactgtactccagcctgggcgacagagcaagactccatctcaaaaaattaaaaaaaaaaaaaaaagaacccaaatggcattttccttgatgtagtcacattttttgtgatgataatgtacaggatatctagcaattatgctggacatataagcacataagatttatgaaatgattttggataatgtataaggtactggaatctggcactttatttgctacttattttcagcactttatttgctattttctgtctctgatgagtagatccccatttgtaccacagtattaatttttaatttttcttgattatcattataaacagaatcagaggcagcactgagttttcaaattactcttgctttgcttcacagttccgtagagatatctcaggggtgcctgtgagcagatgctgagtgaaccctgccccagtcttgtccctacctctaccccacctctgtatcatagaaagagaaccagatgttttaggttcaagtcctgtctcttatatttattaactgtgaaaccctatttcacttctttgagctttgattttcatctttaatgataattatttcagtagatgatgatgatgatgatgatgatgatgtaatgttttaaagtgctaactatgtgccaggcactgaattaagtgtattacaaaatttaatcctcataaaagcccttgtgaattatatggactgttactactattttatagatgaggaaattgagacttagattctgtaactatttttctaaaaactgttctgtgtcggaaatgaaattcaaattccgggcagccaaataccaaagcttgaattcttagccatgagctttatacctcctctgcagaatttttgtgaggattgcatttgctactatatgtggaaggacttcataaaatatgaaactctgtactagggatgccaattcagttgcattcccagtaacatcttaatctattggtaactactgtatagaaagcactgtgatgagaaaagttttttgtgtccacctcaggcgggaatgagaactgagatcagttagtagtatctgctgtgggtatgctttgtccttattgtgttacacatagttcagcgtctgacgggtacgaga

SEQ ID NO: 737194 - DNA, 1463 bp, Homo sapiens
cattgtgatacactgtgatgagtatactatcagaaataacaataagcactatgagaatatggatataacagtttgagttagtcacaagaagatgaaggtttgctgtatttctgacatgtttttttaaatgtgttggatgttttctgcttccttttttggatcatttatatattatttctcaacttttttacttaatattttacgttctgaaatattttatatattgagatatgatattgaagcttttgaatctcttcatgttttcattatattgtatgtacttcagtaattcatagaaatattggaatatatttacttaaaacctaattttttagaaagatattatttaattgactattcttacttgccaggtactttctagaatacttaattttattgtacttttcattatttaccgtttataatttggaggtaagaccattagacccaaagaacttttgtcttggtgtgttcttgtttaaatatggaatttattttacaaaatagttttgttttgtatacatgtctagtctcaagggcgaagtgaaatcttaatgagtctacagaaagttctaagtggactgggtggtgcagcagcttcctcccatcgtgatatttacaagaatgccaggtctctcttgactgataggtcaatggctgttcgatgtgcagtggccaagtgtctactagaactacagaatgaagctgtatttatgtggactgctgaactagaaaatatagccactctctgctttaaggctttggaaaactcaaattatggggtacgagtggcagtgtctaaacttttaggaacagtcatggccacagcattaatgccaaaacaggcaacagtaatgcgtcagaatgtgaagcgagcaacatttgatgaagtcttagaactcatggccacaggatttctgcgtggagggtcaggtttcttaaagagcggtggagaaatgttaaaagttggagggtccgttaatcgtgaagtgagagttggagttacgcaggcgtatgttgtttttgtgacaacattgggtggtcagtggttggagcgcagctttgccacgttcctgtcccatgtacttgatctggtttcccatcctcgggcaacacaaacacatgtggaggctgtgtactccagacgatgtgtttcctttatcctaagagctactgtgggcagtttgctaggtgaaaaagcccagattgcagctgccaaagaaatctgccaagctattggaaaacaaatgaaagccgtagaagcagtagtgaatgacacaagtggagaaaacaaatctggcgcagcagacattgcagcaagccagcatgtgatggtctgtgccctccaggaactcgggagcctggtgcagagcttgaatgccaccgcatcccctcttattcaagaagcatctatagggcttttggagattgtgacttcagtgctgcttcatccaagcatggct

SEQ ID NO: 737195 - DNA, 314 bp, Homo sapiens
  misc_feature (231)..(231): n is a, c, g, or t
acttctttaacaagcccccccgtttcccctgaccttcacgaaagccgaaggaggcggggaaagggggtgagggtcttttccaaagggtactgacctcttcccaacgtctccccctgctcgccagtccgccacacgtacccagcttttgagttcagcttttcaaaataaccacaatcatgataaacttctacaaaacgtgattctcctcccctcccaccccatcccccaagncaatagtgtgggattcggggagggagagagcgagctaaagggactctttccaagtccggctcccccttttccccccggccgcc

SEQ ID NO: 737196 - DNA, 1491 bp, Homo sapiens
ggaaagggggcaaagctgattgattacaagtaaaatgaaaaaatactgtttctgctaagacagaaagggacctttaatacgcgcccttttaatctgattgtcagaagtaggacagtgcacagtttctcaaagatggccagaggatctgataaaatacaaaagaattgtggaggcgatagtaaacattcttcttcctgtgctgctgatccacaggcttctctttgagaatgactggcctgcaagctgacaagggtgtttacccgctgactctggtggagtccatttggttcaccagaagggcttgagggcagacaaaagaccttgagctctctgcgtgtgccagtcatcctgtgtttcctgacccctgtctctctcagaacccactcacagaaccagatccgagagcctgggagagcttgcccggatttcagcccttgatttgccacttaagcacgtgattgccatctgtgcttgcttaaaggggatgctgattaggagagtgatacttcatttggataatacgatttaagcccaagtgcaagaggtgttgcttgtgctggaactgcaggaaatatgagccatgtaaacgcaccacccaacctcctgcagtggtccaggtggtcctaccggtcactgactacagtatgtctgtgtgggagatgacagtgatcccaagccctggtttccatgcaggcatatggactcctgcttaatgagattgaaggatagtaattgtctccacccttatttagatgatgcccatcgctctggcgtttgtgttttcaaatgttttggataaagcgagtgccgggagagtgtgctatttagtgagctcagtccagcctcggtcttgagcattgactgtgggtcctctgctgttggggttctcgacttgcccaccagctgccttatctcaggttgagaaaggtagtgggaaccccattttgcaaatggggaaactcttggtgacttgaagtcacctggttaaaatggcacacaactttgaagctgcctgccattttaaccaagtgtgccagacataagtttctggagtgtgtatctcgtctatgtgacactccagtaccaggttcttcccacctcagggatcagtttatggaaacacctcagaattgagaccagggcttctcaatctgtgatttggggctggataaatattagttgtgaggggcgtgttgtgcattgtaggttggttagcagcgttctcggcctctacaccctctcagttgtgaaaaccaaaaatgtgtattgagatcagccctggttgagaatcaccaagctagacctctttgggttttgttgggcaatttaacggaactctggctatgccttttttgaggcagttgtagctagcttggttcattgaagctaggtttgaaatcattcataactaagttatgatgttaggaattcgacagtccatgcattgtttcatctgaaaaacaactactctaccttgcacgacaacacata

SEQ ID NO: 737197 - DNA, 749 bp, Homo sapiens
  misc_feature (623)..(623): n is a, c, g, or t
cggaaatttcggagactgtagagaaagtcattcttccacccagacctgtattgaatgatgtaagtgctgcattacagaagctgtgtggagaagtatggttaagttatccagctggaagggaattaggtcctggagaagtgaacccagaatttcctgaagcagtacagccagtatgtagccccctaaatcctccaggagtgatatcaccatgggctacgatggacaccatagttccagacaggaaggatttttattcctccaatgtagttcctgataaaactcatgaagttggatcttatttagctgcccaaatgtctccatcagaccagacgcttagctcatttgcttccattgttgctcaatatggcaaaggcctccctcaggaagtggaagaaattgtgagggaaacaattgttcaacccaaatcagagttcctcgaattcagtgctggcttagaaaaactactgaaggaagaaactgaaaccttcccctcaaaatatgaaagtgatacagggaatctttctccatcaaagttaataggtagtacagaggagcccaggcgagccacttctgaatgccatcctgaggaattaaaagaaacagtagaaaaggccgaggctccnttaataactgagagtgcttttgatgctggttttgagaaacttcttaaagaaataactgaagctcctccttatcagccccaggtgtcagtgagagaagaaactcacgagaaggagtcctcacagtca

SEQ ID NO: 737198 - DNA, 1830 bp, Homo sapiens
tatcgagtttatatttcatctccccaacgcatttgtgacattcttaagggcgtgaaccatgtactcaatagggccctgatgatagaaaagaaaatcagcttggtccctgttctcaagttcatagtttagtgtgggagactaatacaataactcgccgattcaacagatatttttccaacgtccgtatgtattgggtggaaaaggtgaggcaagagttgtatttcccagactcctgaacaggttgcgagatgattgactcctgagggagaccttctcaccttttcattggttgtcgctggccctctcgtctatcacccaaccaaccccgaatgcctcttgtaagccccacctccggcagccagccaatcagaagtgccgggggccagggtgctgctggggcactgacgcggtttcgattctagcgaaaaatgatttggctcggactgtcccgtgacaggcggtgcgaggaggccaggcccgcgcccgccgagccctagggccgctgctgccgacagccatggaggacgagcagcctgacagcctggagggctgggtgccggtccgggagggcctcttcgccgagcccgagaggcaccggctgcgcttcctggtggcctggaacggcgcggagggcaagttcgctgtgacttgtcacgaccgtaccgcgcagcagcggcggctgcgcgagggggcccggttggggcccgagcccgagcccaagcctgaggccgccgtctccccgtccagctgggccggcctgctctcggccgcggggctccgcggcgcgcaccggcagttggcggcgctgtggccgcctctggagcgctgcttcccgcggctgccgccggagctggacgtgggcggcggcggggcctggggtctggggctcgggctgtgggcgctgctgtggccgacgcgcgcgggtcccggcgaggcggcgctgcaggagctgtgcgggcagctggaacgctatctgggcgcggcggccgacggctgcggcggcgccacagtgcgcgacgcactcttcccggctgagggcggcgcggccgactgcgaaagcccgcgcgagttccgggagcgggccttgcgcgcgcggtgggtcgaggcggacgcgcggctgcgccaggttattcaaggacacggaaaagccaacaccatggtagcattaatgaacgtttaccaagaggaagatgaagcataccaggaattggttaccgtggcaaccatgttcttccagtacttattgcagccatttagggctatgcgagaagttgcaactttatgtaagcttgatattttgaagtctttggatgaggatgacctaggtcctagaagggtagttgccctggagaaagaagctgaagaatggaccagacgggctgaagaagctgtcgtctctattcaggatatcacagtgaattattttaaggagacagtaaaagcattagcaggaatgcagaaagaaatggaacaggatgcgaagagatttggtcaggctgcctgggccacagcaattcccaggttggaaaaacttcagctaatgctagctcgagagactctgcaactcatgagagcgaaagagttgtgtttaaatcacaaaagagctgaaattcagggaaagatggaagatcttccagaacaagaaaaaaatacaaatgttgtagatgaattagaaatacaattttatgaaattcaattagaactatatgaagttaaatttgagatattaaaaaacgaagaaatactgcttactacacagttggactctcttaaaagacttataaaagatgaaatttagaatcaagttcaaaacaaaaactcgttggaatt

SEQ ID NO: 737199 - DNA, 1682 bp, Homo sapiens
tcagtggtgggattacaagtgatctttatttttcttacatttaaaaaaattcaatgcattttttaaaataataaaatatgttttaaacaatcattaatacatttttagaaaaacaagatgaagttgtctattacgatccatgtgaaaatccagaggaacttaaagtcattgactgtgtggtggggctgcaggatgataagaatttggaagtgaaagaactcagaaggcagtgccagcagctggagtctaaacggggcaggatctgtgccaaaagagcctctctccggagtagaaaggtaggtacgctcagagcggctttcttttcttttctctttcagagatttattcttgtatgaaggataaaggtattgaaataaggtttttaccaacacagtgattacattttgtgtgcttatgtacttatccatggctatagttaaaatgcttttaaatatttttcttaaaaatattttttttcttttgggatttaagcatttagcaaatctcaaggttttaatttattcattcaacaactatttgttgaatgcccattgcatacacaggcacacaggcactttatttttatttttttgagacagagtcttgctctgtcacccaggctagagtgcagaggcatgatgttggctcactgcaacttctgcctcctaggttcaagcgatcctcatgccttagcctgccaagtagctgggtttacaggcacgcgccagcacgcccagctaatttttgtatattttgtagaggtggggtttcaccatgttggctaggctggtcttgaactcctgacctcaagtgatccgcccaccttggcctcccaaagtgctgggattacaggtgtgagccaccacccctggaccacagtactttaaaaaccacaataggtagaaactctatttctaatagccaactataacaattctaaatatattttactgtaaattattgagtacacaaaagaattacagataacaatattcagctcacctcagacattatatttggtgattttttttcttaattttaaaaaatccatgaatacataaaaagataacactaagaaatttaattttctctgacagaaaaggaagctcctatatatcatttttatacagacttttatattatacttttctcctttttttttttttgaaacagagtctcgctctgtctcctagtctggagtgcaatggcgcaatctcagctcactgcaacctccacctcccaggttcaagcgagtcttctgcctcagcctcccgtgtagctgggattacaggtgcctgccaccacacccggctaatatatatatatatatatttttgagatgggagtctcactctgtcgccaggctggagtgcagtggcacgatctcggctcactgcaaccttcatctccaggattcaagcctgcctcagccccctgagtagctgggattacaggcatgtgccaccacccctggctaatttttgtatttttagtagagacggggtttcaccatgttggccaagctggtcttgaactcctgacctcaggtgatccacccgccttggcctcccaaagtgctgggattacgggcatgagtcacagcgcctggccacacccggctaatttttgtatttttagtagagacggggtttcaccatgttggtcagactggtcttgaattc

SEQ ID NO: 737200 - DNA, 4277 bp, Homo sapiens
tatcgagtttatatttcatctccccaacgcatttgtgacattcttaagggcgtgaaccatgtactcaatagggccctgatgatagaaaagaaaatcagcttggtccctgttctcaagttcatagtttagtgtgggagactaatacaataactcgccgattcaacagatatttttccaacgtccgtatgtattgggtggaaaaggtgaggcaagagttgtatttcccagactcctgaacaggttgcgagatgattgactcctgagggagaccttctcaccttttcattggttgtcgctggccctctcgtctatcacccaaccaaccccgaatgcctcttgtaagccccacctccggcagccagccaatcagaagtgccgggggccagggtgctgctggggcactgacgcggtttcgattctagcgaaaaatgatttggctcggactgtcccgtgacaggcggtgcgaggaggccaggcccgcgcccgccgagccctagggccgctgctgccgacagccatggaggacgagcagcctgacagcctggagggctgggtgccggtccgggagggcctcttcgccgagcccgagaggcaccggctgcgcttcctggtggcctggaacggcgcggagggcaagttcgctgtgacttgtcacgaccgtaccgcgcagcagcggcggctgcgcgagggggcccggttggggcccgagcccgagcccaagcctgaggccgccgtctccccgtccagctgggccggcctgctctcggccgcggggctccgcggcgcgcaccggcagttggcggcgctgtggccgcctctggagcgctgcttcccgcggctgccgccggagctggacgtgggcggcggcggggcctggggtctggggctcgggctgtgggcgctgctgtggccgacgcgcgcgggtcccggcgaggcggcgctgcaggagctgtgcgggcagctggaacgctatctgggcgcggcggccgacggctgcggcggcgccacagtgcgcgacgcactcttcccggctgagggcggcgcggccgactgcgaaagcccgcgcgagttccgggagcgggccttgcgcgcgcggtgggtcgaggcggacgcgcggctgcgccaggttattcaaggacacggaaaagccaacaccatggtagcattaatgaacgtttaccaagaggaagatgaagcataccaggaattggttaccgtggcaaccatgttcttccagtacttattgcagccatttagggctatgcgagaagttgcaactttatgtaagcttgatattttgaagtctttggatgaggatgacctaggtcctagaagggtagttgccctggagaaagaagctgaagaatggaccagacgggctgaagaagctgtcgtctctattcaggatatcacagtgaattattttaaggagacagtaaaagcattagcaggaatgcagaaagaaatggaacaggatgcgaagagatttggtcaggctgcctgggccacagcaattcccaggttggaaaaacttcagctaatgctagctcgagagactctgcaactcatgagagcgaaagagttgtgtttaaatcacaaaagagctgaaattcagggaaagatggaagatcttccagaacaagaaaaaaatacaaatgttgtagatgaattagaaatacaattttatgaaattcaattagaactatatgaagttaaatttgagatattaaaaaacgaagaaatactgcttactacacagttggactctcttaaaagacttataaaagaaaaacaagatgaagttgtctattacgatccatgtgaaaatccagaggaacttaaagtcattgactgtgtggtggggctgcaggatgataagaatttggaagtgaaagaactcagaaggcagtgccagcagctggagtctaaacggggcaggatctgtgccaaaagagcctctctccggagtagaaaggatcagtgcaaagaaaatcatcggttcagattgcaacaggctgaagaaagcataagatactctcgtcagcatcacagtattcagatgaaaagagacaagataaaagaagaggagcaaaagaaaaaagaatggatcaaccaagaacgtcaaaaaacactccaacgattgagatcatttaaagataaacgcctagctcaatctgtccgaaacacctctggctcagaacctgtggctccaaacctgccaagtgatctttcccagcagatgtgcttgccagcttcccacgcggtgtcagtaattcacccgtcctctaggaaaactagaggtgttcccctatcggaagctggtaatgtgaaaagccccaagtgtcaaaactgtcatggaaatatccctgtccaggtttttgttccagttggtgatcaaacacattccaaatccagtgaggaattgtcactgccaccacctcctcctcctccaccaccaccaccgccgccaccgccgcccccaccccctcctctccgtgctctgtcctcatcctctcaagctgcaactcatcagaacttaggcttccgggctccagtgaaagatgaccagccacgtcctctagtgtgcgaatcacctgctgagcgaccacgtgactccttggaaagtttttcatgtccaggatctatggatgaagtgttggcctccttaaggcatggcagagctcctctccggaaggtggaagtgccggcggtgcgccctccccacgcctcaatcaatgagcacattctggctgccataaggcaaggggtcaaactgaagaaagttcaccctgatcttggcccaaaccccagcagcaaaccaaccagcaacagacgcaccagtgaccttgagaggagcatcaaggctgcgctccagagaatcaagagggtgtctgctgactctgaggaggacagtgatgagcaggaccctggccagtgggatggttaggctcaagtttgacaaaggcacctgccacagtaggcttgaataaagtgggtgagtcttagacctatcgaaaagcatactaacagggtgctgatagatgggccacataacaccccggaagatcagcagggccttgtgtaggctgctgcagcattttttttttttttcttttttgagatggagtctcactctgtcgcccaggctggggtgcagtggcgccatctcggctcaccgcaagctccgcttcccaggctggggtgcagtggtgcgatcttggctcactgcaagctccgcctcctgggttcacgccattctcctgcctcagcctcccgagtagctgggactacaggcgccaccaccttgcccaactaattttttgtattttttagtagagacgaggtttcaccgtgttagccaggatggtctcgatcttctgacctcgtgatccgcctgcctcagactcccaaagtgctgggattacaggtgtgagccaccacgcccagccttttttttttctttcttttgagacagaatctctctgtcatccaggctagagtgcagtggcacgatcttggcttactgcaacctccacctcccaggttcaagcaattctctgtctcagcctcccgagtagctgggattacaggcatgcaccaccacgcctggctaatttttgtatatttaagtagagacaaggtttcgctatgttggccaggctggtcttgaactcctgacctcgtgatccacctgccttggccacccaaagtgttgggattataggcatgagccaccgtgcctggctgatgctggagcttttatgtgacatggtgactcttaaaactggggagggacgtagagatgagagtttcacacaccagcccataggtgggatgtcaagacccatcggaagtgtcgctggcctaagagaagagcacttatttctcaccatggctgatctagaattgttccctgattctgaaagaagtttacactacactggtaagcagtactattagactactgactgtggccttctgtgcatatggaataatgatttctcagatttgtaggcttgaatgtgaatgttattttatcagtaatcagaataaattgcttatattcaggagttattttaaatatttaaatgaaatttattttaggcaccaagcaccacataaactcataataactatttgcaatgcattagcatcactcacggggtaatgaaaacataccttagctgctgtaaaagcaaagtcttccgtgtccgggtgggctgaaagtttttaataaaattttagctaaacatttgtttaagtgaatactaaggatg

SEQ ID NO: 737201 - DNA, 4713 bp, Homo sapiens
tatcgagtttatatttcatctccccaacgcatttgtgacattcttaagggcgtgaaccatgtactcaatagggccctgatgatagaaaagaaaatcagcttggtccctgttctcaagttcatagtttagtgtgggagactaatacaataactcgccgattcaacagatatttttccaacgtccgtatgtattgggtggaaaaggtgaggcaagagttgtatttcccagactcctgaacaggttgcgagatgattgactcctgagggagaccttctcaccttttcattggttgtcgctggccctctcgtctatcacccaaccaaccccgaatgcctcttgtaagccccacctccggcagccagccaatcagaagtgccgggggccagggtgctgctggggcactgacgcggtttcgattctagcgaaaaatgatttggctcggactgtcccgtgacaggcggtgcgaggaggccaggcccgcgcccgccgagccctagggccgctgctgccgacagccatggaggacgagcagcctgacagcctggagggctgggtgccggtccgggagggcctcttcgccgagcccgagaggcaccggctgcgcttcctggtggcctggaacggcgcggagggcaagttcgctgtgacttgtcacgaccgtaccgcgcagcagcggcggctgcgcgagggggcccggttggggcccgagcccgagcccaagcctgaggccgccgtctccccgtccagctgggccggcctgctctcggccgcggggctccgcggcgcgcaccggcagttggcggcgctgtggccgcctctggagcgctgcttcccgcggctgccgccggagctggacgtgggcggcggcggggcctggggtctggggctcgggctgtgggcgctgctgtggccgacgcgcgcgggtcccggcgaggcggcgctgcaggagctgtgcgggcagctggaacgctatctgggcgcggcggccgacggctgcggcggcgccacagtgcgcgacgcactcttcccggctgagggcggcgcggccgactgcgaaagcccgcgcgagttccgggagcgggccttgcgcgcgcggtgggtcgaggcggacgcgcggctgcgccaggttattcaaggacacggaaaagccaacaccatggtagcattaatgaacgtttaccaagaggaagatgaagcataccaggaattggttaccgtggcaaccatgttcttccagtacttattgcagccatttagggctatgcgagaagttgcaactttatgtaagcttgatattttgaagtctttggatgaggatgacctaggtcctagaagggtagttgccctggagaaagaagctgaagaatggaccagacgggctgaagaagctgtcgtctctattcaggatatcacagtgaattattttaaggagacagtaaaagcattagcaggaatgcagaaagaaatggaacaggatgcgaagagatttggtcaggctgcctgggccacagcaattcccaggttggaaaaacttcagctaatgctagctcgagagactctgcaactcatgagagcgaaagagttgtgtttaaatcacaaaagagctgaaattcagggaaagatggaagatcttccagaacaagaaaaaaatacaaatgttgtagatgaattagaaatacaattttatgaaattcaattagaactatatgaagttaaatttgagatattaaaaaacgaagaaatactgcttactacacagttggactctcttaaaagacttataaaagaaaaacaagatgaagttgtctattacgatccatgtgaaaatccagaggaacttaaagtcattgactgtgtggtggggctgcaggatgataagaatttggaagtgaaagaactcagaaggcagtgccagcagctggagtctaaacggggcaggatctgtgccaaaagagcctctctccggagtagaaaggatcagtgcaaagaaaatcatcggttcagattgcaacaggctgaagaaagcataagatactctcgtcagcatcacagtattcagatgaaaagagacaagataaaagaagaggagcaaaagaaaaaagaatggatcaaccaagaacgtcaaaaaacactccaacgattgagatcatttaaagataaacgcctagctcaatctgtccgaaacacctctggctcagaacctgtggctccaaacctgccaagtgatctttcccagcagatgtgcttgccagcttcccacgcggtgtcagtaattcacccgtcctctaggaaaactagaggtgttcccctatcggaagctggtaatgtgaaaagccccaagtgtcaaaactgtcatggaaatatccctgtccaggtttttgttccagttggtgatcaaacacattccaaatccagtgaggaattgtcactgccaccacctcctcctcctccaccaccaccaccgccgccaccgccgcccccaccccctcctctccgtgctctgtcctcatcctctcaagctgcaactcatcagaacttaggcttccgggctccagtgaaagatgaccagccacgtcctctagtgtgcgaatcacctgctgagcgaccacgtgactccttggaaagtttttcatgtccaggatctatggatgaagtgttggcctccttaaggcatggcagagctcctctccggaaggtggaagtgccggcggtgcgccctccccacgcctcaatcaatgagcacattctggctgccataaggcaaggggtcaaactgaagaaagttcaccctgatcttggcccaaaccccagcagcaaaccaaccagcaacagacgcaccagtgaccttgagaggagcatcaaggctgcgctccagagaatcaagagggtgtctgctgactctgaggaggacagtgatgagcaggaccctggccagtgggatggttaggctcaagtttgacaaaggcacctgccacagtaggcttgaataaagtgggtgagtcttagacctatcgaaaagcatactaacagggtgctgatagatgggccacataacaccccggaagatcagcagggccttgtgtaggctgctgcagcattttttttttttttcttttttgagatggagtctcactctgtcgcccaggctggggtgcagtggcgccatctcggctcaccgcaagctccgcttcccaggctggggtgcagtggtgcgatcttggctcactgcaagctccgcctcctgggttcacgccattctcctgcctcagcctcccgagtagctgggactacaggcgccaccaccttgcccaactaattttttgtattttttagtagagacgaggtttcaccgtgttagccaggatggtctcgatcttctgacctcgtgatccgcctgcctcagactcccaaagtgctgggattacaggtgtgagccaccacgcccagccttttttttttctttcttttgagacagaatctctctgtcatccaggctagagtgcagtggcacgatcttggcttactgcaacctccacctcccaggttcaagcaattctctgtctcagcctcccgagtagctgggattacaggcatgcaccaccacgcctggctaatttttgtatatttaagtagagacaaggtttcgctatgttggccaggctggtcttgaactcctgacctcgtgatccacctgccttggccacccaaagtgttgggattataggcatgagccaccgtgcctggctgatgctggagcttttatgtgacatggtgactcttaaaactggggagggacgtagagatgagagtttcacacaccagcccataggtgggatgtcaagacccatcggaagtgtcgctggcctaagagaagagcacttatttctcaccatggctgatctagaattgttccctgattctgaaagaagtttacactacactggtaagcagtactattagactactgactgtggccttctgtgcatatggaataatgatttctcagatttgtaggcttgaatgtgaatgttattttatcagtaatcagaataaattgcttatattcaggagttattttaaataaaaaaaaaaaacaaaaaaaaaaacaacaaaaaaaaaaaaaaaaaaaaagcaaaacacacaaaacgcaaacaaaacaaacccaaaggagagcgaagagcggagggacgagcggcaggacgagacgcggaggcagaggggacgagcagaccgaacgcgcggagcgcagacacggccaccgcggggccgccaacgggaacggcgcggcaccaagagaggaggaccggcgcagcgggcggagcggcggcgagggagagagagggaagaccgggcggacccagagggcggcgcagcgccgggaggccacagcggcggagcagcggcggcgcgcggcgggcagccgggggcacgcagtaccgccggcgtcgggcgcacaggcgccgagcgcgaacagacgcgggacgaaccgtcgcgaggcagagaagcgcgaggagaggacagcaaacgggagcacgcgaggcgcgaaggacgggacagcacgaggcgcgcagccgaggagagaccggccgcggaccgcccgcggcaccggcggccgctggggcgcacgccgcgccgcggcccgcccccgcgccgcccgccccgcccccgcccccccccgcgcgacccccccgggcgggacgacgggcgacgaca

SEQ ID NO: 737202 - DNA, 4735 bp, Homo sapiens
tatcgagtttatatttcatctccccaacgcatttgtgacattcttaagggcgtgaaccatgtactcaatagggccctgatgatagaaaagaaaatcagcttggtccctgttctcaagttcatagtttagtgtgggagactaatacaataactcgccgattcaacagatatttttccaacgtccgtatgtattgggtggaaaaggtgaggcaagagttgtatttcccagactcctgaacaggttgcgagatgattgactcctgagggagaccttctcaccttttcattggttgtcgctggccctctcgtctatcacccaaccaaccccgaatgcctcttgtaagccccacctccggcagccagccaatcagaagtgccgggggccagggtgctgctggggcactgacgcggtttcgattctagcgaaaaatgatttggctcggactgtcccgtgacaggcggtgcgaggaggccaggcccgcgcccgccgagccctagggccgctgctgccgacagccatggaggacgagcagcctgacagcctggagggctgggtgccggtccgggagggcctcttcgccgagcccgagaggcaccggctgcgcttcctggtggcctggaacggcgcggagggcaagttcgctgtgacttgtcacgaccgtaccgcgcagcagcggcggctgcgcgagggggcccggttggggcccgagcccgagcccaagcctgaggccgccgtctccccgtccagctgggccggcctgctctcggccgcggggctccgcggcgcgcaccggcagttggcggcgctgtggccgcctctggagcgctgcttcccgcggctgccgccggagctggacgtgggcggcggcggggcctggggtctggggctcgggctgtgggcgctgctgtggccgacgcgcgcgggtcccggcgaggcggcgctgcaggagctgtgcgggcagctggaacgctatctgggcgcggcggccgacggctgcggcggcgccacagtgcgcgacgcactcttcccggctgagggcggcgcggccgactgcgaaagcccgcgcgagttccgggagcgggccttgcgcgcgcggtgggtcgaggcggacgcgcggctgcgccaggttattcaaggacacggaaaagccaacaccatggtagcattaatgaacgtttaccaagaggaagatgaagcataccaggaattggttaccgtggcaaccatgttcttccagtacttattgcagccatttagggctatgcgagaagttgcaactttatgtaagcttgatattttgaagtctttggatgaggatgacctaggtcctagaagggtagttgccctggagaaagaagctgaagaatggaccagacgggctgaagaagctgtcgtctctattcaggatatcacagtgaattattttaaggagacagtaaaagcattagcaggaatgcagaaagaaatggaacaggatgcgaagagatttggtcaggctgcctgggccacagcaattcccaggttggaaaaacttcagctaatgctagctcgagagactctgcaactcatgagagcgaaagagttgtgtttaaatcacaaaagagctgaaattcagggaaagatggaagatcttccagaacaagaaaaaaatacaaatgttgtagatgaattagaaatacaattttatgaaattcaattagaactatatgaagttaaatttgagatattaaaaaacgaagaaatactgcttactacacagttggactctcttaaaagacttataaaagaaaaacaagatgaagttgtctattacgatccatgtgaaaatccagaggaacttaaagtcattgactgtgtggtggggctgcaggatgataagaatttggaagtgaaagaactcagaaggcagtgccagcagctggagtctaaacggggcaggatctgtgccaaaagagcctctctccggagtagaaaggtgatttgtattattccaccaggatcagtgcaaagaaaatcatcggttcagattgcaacaggctgaagaaagcataagatactctcgtcagcatcacagtattcagatgaaaagagacaagataaaagaagaggagcaaaagaaaaaagaatggatcaaccaagaacgtcaaaaaacactccaacgattgagatcatttaaagataaacgcctagctcaatctgtccgaaacacctctggctcagaacctgtggctccaaacctgccaagtgatctttcccagcagatgtgcttgccagcttcccacgcggtgtcagtaattcacccgtcctctaggaaaactagaggtgttcccctatcggaagctggtaatgtgaaaagccccaagtgtcaaaactgtcatggaaatatccctgtccaggtttttgttccagttggtgatcaaacacattccaaatccagtgaggaattgtcactgccaccacctcctcctcctccaccaccaccaccgccgccaccgccgcccccaccccctcctctccgtgctctgtcctcatcctctcaagctgcaactcatcagaacttaggcttccgggctccagtgaaagatgaccagccacgtcctctagtgtgcgaatcacctgctgagcgaccacgtgactccttggaaagtttttcatgtccaggatctatggatgaagtgttggcctccttaaggcatggcagagctcctctccggaaggtggaagtgccggcggtgcgccctccccacgcctcaatcaatgagcacattctggctgccataaggcaaggggtcaaactgaagaaagttcaccctgatcttggcccaaaccccagcagcaaaccaaccagcaacagacgcaccagtgaccttgagaggagcatcaaggctgcgctccagagaatcaagagggtgtctgctgactctgaggaggacagtgatgagcaggaccctggccagtgggatggttaggctcaagtttgacaaaggcacctgccacagtaggcttgaataaagtgggtgagtcttagacctatcgaaaagcatactaacagggtgctgatagatgggccacataacaccccggaagatcagcagggccttgtgtaggctgctgcagcattttttttttttttcttttttgagatggagtctcactctgtcgcccaggctggggtgcagtggcgccatctcggctcaccgcaagctccgcttcccaggctggggtgcagtggtgcgatcttggctcactgcaagctccgcctcctgggttcacgccattctcctgcctcagcctcccgagtagctgggactacaggcgccaccaccttgcccaactaattttttgtattttttagtagagacgaggtttcaccgtgttagccaggatggtctcgatcttctgacctcgtgatccgcctgcctcagactcccaaagtgctgggattacaggtgtgagccaccacgcccagccttttttttttctttcttttgagacagaatctctctgtcatccaggctagagtgcagtggcacgatcttggcttactgcaacctccacctcccaggttcaagcaattctctgtctcagcctcccgagtagctgggattacaggcatgcaccaccacgcctggctaatttttgtatatttaagtagagacaaggtttcgctatgttggccaggctggtcttgaactcctgacctcgtgatccacctgccttggccacccaaagtgttgggattataggcatgagccaccgtgcctggctgatgctggagcttttatgtgacatggtgactcttaaaactggggagggacgtagagatgagagtttcacacaccagcccataggtgggatgtcaagacccatcggaagtgtcgctggcctaagagaagagcacttatttctcaccatggctgatctagaattgttccctgattctgaaagaagtttacactacactggtaagcagtactattagactactgactgtggccttctgtgcatatggaataatgatttctcagatttgtaggcttgaatgtgaatgttattttatcagtaatcagaataaattgcttatattcaggagttattttaaataaaaaaaaaaaacaaaaaaaaaaacaacaaaaaaaaaaaaaaaaaaaaagcaaaacacacaaaacgcaaacaaaacaaacccaaaggagagcgaagagcggagggacgagcggcaggacgagacgcggaggcagaggggacgagcagaccgaacgcgcggagcgcagacacggccaccgcggggccgccaacgggaacggcgcggcaccaagagaggaggaccggcgcagcgggcggagcggcggcgagggagagagagggaagaccgggcggacccagagggcggcgcagcgccgggaggccacagcggcggagcagcggcggcgcgcggcgggcagccgggggcacgcagtaccgccggcgtcgggcgcacaggcgccgagcgcgaacagacgcgggacgaaccgtcgcgaggcagagaagcgcgaggagaggacagcaaacgggagcacgcgaggcgcgaaggacgggacagcacgaggcgcgcagccgaggagagaccggccgcggaccgcccgcggcaccggcggccgctggggcgcacgccgcgccgcggcccgcccccgcgccgcccgccccgcccccgcccccccccgcgcgacccccccgggcgggacgacgggcgacgaca

SEQ ID NO: 737203 - DNA, 952 bp, Homo sapiens
gcctcccaaagtgctgggattacaggcatgagccaccgcgcccggcctaagatttcttattgtggtattctgcagtggagaatgggagttggaaagaaatgttttctcccacacctgtcccgctcctgtctactgaaagctgattaatcagtcagatagtgagttcctattggtagtacgcctccaaaatttggaagaggggaggtggcgtgatgtgaaaaagcaaggctttagggagagattcccgctgggggcattcaccctctggtccagcgtgcctgttacagtgatcactccatagtggttttgcatgaacaagactgcccagtttgcttaggaagaaaacaaaggacataaggtagttctcatgtcttcccagcaccctaaatactcgggctaaacttccacagtcagaccgtcagcttcaggaagggctgctgttgggaactttttttttagtttgcagttagttcagctccagccaaaaacctacaaaaagccactgcaagccctctgcctgctcgtataagacaccttggttgggcccctgtgactgtccatccataggatggttggccattgactgcacagagaggtagggcaagataaaacgactcatttgtggatctgactccttgtacttctgtttggattcaaacagaggaagatagagtagtggccttgggaaaccgtggagagagaaaaggcatagtcagaatgttttcagaggagcgcagacttttcaaaacccctctcatcacgttcccactgaccttcagttccagtgctgtggccacagggtgtctgcaccccaacttctttgccaagaaattaatgatctgtgaagacacacagacatgaggcggacttactatttaaaggaatcctgaaacgaatatttttctgatacatatttatcctaatatatttgctgagcatggttttttttttt

SEQ ID NO: 737204 - DNA, 579 bp, Homo sapiens; identical to SEQ ID NO: 94211

SEQ ID NO: 737205 - DNA, 1997 bp, Homo sapiens
tgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggaacctgctagaccttgataccttctccaagtccgaccccatggtggtgctttacacgcagagccgggccagccaggagtggcgggagttcggacggaccgaggtgattgataacacgctgaacccagacttcgtgcgcaaattcgtcctcgactatttctttgaggaaaagcaaaatctgcgcttcgatgtgtacaacgtggactccaaaaccaacatctccaaaccggatttcctgggacaagcgttcctggccctgggagaggtgattggaggccagggcagccgagtagagcgaaccctcacgggtgtaccaggcaagaagtgtgggaccatattgctgactgcagaagagcttagcaattgtcgggacattgccaccatgcagctgtgtgcaaacaagctggacaagaaggacttctttgggaaatcagaccccttccttgtgttctacaggagcaatgaggatggcacgttcaccatctgccacaagacagaggttgtgaaaaacacgctgaatcctgtgtggcagcccttcagcatccctgtgcgggctctgtgcaatggagactatgacagaacggtgaagattgatgtgtacgactgggaccgggatggaagccacgatttcattggtgagttcaccaccagctaccgggagctgagcaaggcccagaaccagttcacagtatatgaggttcttaaccctcggaagaaatgtaagaagaagaaatatgtcaactcaggaactgtgacgctgctctccttctctgtggactctgaattcacttttgttgattacatcaagggagggacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctgaacaacaatgatgaggaccccaactgtgcgggcatcgagggtgtgctggagagctatttccagagcctgcgcacagtgcagctctatgggcccacctactttgctcctgtcatcaaccaagtggccagggctgcagccaagatctctgatggctcccagtactatgttctgctcatcatcactgatggggtcatctctgacatgacgcagaccaaggaggccatcgtcagcgcctcctcattgcccatgtctatcattatcgtcggtgtaggaccagccatgtttgaggcaatggaagagttggacggtgatgatgtgcgcgtgtcctctaggggacgctacgcagagcgggacatcgttcagttcgtcccattccgagactatgttgaccggtcggggaaccaggtgttgagcatggcccgactggccaaggatgtgctggccgagatcccggagcagctgctgtcctatatgcgcaccagagacatccagcctcggcccccaccccctgccaaccccagcccgatcccagctccagagcagccctgaggattccacatatccaatgcctcacagtctgcaagcctgctcacccactgcttctgctttaagccagaggcacctggaaccctggacttcactgggagggccaacttggaggatcagtgctggctgacaagccctccgcctccttgcctgcagagggcctggcactatcaccacctctctgccttcatgccaataataaagctgatctttattccaaaaa

SEQ ID NO: 737206 - DNA, 1935 bp, Homo sapiens
tgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggaacctgctagaccttgataccttctccaagtccgaccccatggtggtgctttacacgcagagccgggccagccaggagtggcgggagttcggacggaccgaggtgattgataacacgctgaacccagacttcgtgcgcaaattcgtcctcgactatttctttgaggaaaagcaaaatctgcgcttcgatgtgtacaacgtggactccaaaaccaacatctccaaaccggatttcctgggacaagcgttcctggccctgggagaggtgattggaggccagggcagccgagtagagcgaaccctcacgggtgtaccaggcaagaagtgtgggaccatattgctgactgcagaagagcttagcaattgtcgggacattgccaccatgcagctgtgtgcaaacaagctggacaagaaggacttctttgggaaatcagaccccttccttgtgttctacaggagcaatgaggatggcacgttcaccatctgccacaagacagaggttgtgaaaaacacgctgaatcctgtgtggcagcccttcagcatccctgtgcgggctctgtgcaatggagactatgacagaacggtgaagattgatgtgtacgactgggaccgggatggaagccacgatttcattggtgagttcaccaccagctaccgggagctgagcaaggcccagaaccagttcacagtatatgaggttcttaaccctcggaagaaatgtaagaagaagaaatatgtcaactcaggaactgacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctgaacaacaatgatgaggaccccaactgtgcgggcatcgagggtgtgctggagagctatttccagagcctgcgcacagtgcagctctatgggcccacctactttgctcctgtcatcaaccaagtggccagggctgcagccaagatctctgatggctcccagtactatgttctgctcatcatcactgatggggtcatctctgacatgacgcagaccaaggaggccatcgtcagcgcctcctcattgcccatgtctatcattatcgtcggtgtaggaccagccatgtttgaggcaatggaagagttggacggtgatgatgtgcgcgtgtcctctaggggacgctacgcagagcgggacatcgttcagttcgtcccattccgagactatgttgaccggtcggggaaccaggtgttgagcatggcccgactggccaaggatgtgctggccgagatcccggagcagctgctgtcctatatgcgcaccagagacatccagcctcggcccccaccccctgccaaccccagcccgatcccagctccagagcagccctgaggattccacatatccaatgcctcacagtctgcaagcctgctcacccactgcttctgctttaagccagaggcacctggaaccctggacttcactgggagggccaacttggaggatcagtgctggctgacaagccctccgcctccttgcctgcagagggcctggcactatcaccacctctctgccttcatgccaataataaagctgatctttattccaaaaa

SEQ ID NO: 737207 - DNA, 1416 bp, Homo sapiens
tattaacagtgcatgccagaaataggatccagaaatttaagtggaataaatggaaagttctggactttggtttaacaaacccgtgacacagctgaaagattttagctgactaaatgctcaatatgagttcataggaaccaagccacgttaagcagctcatgtttcccctttgccttcaggatgccagatccctccttagtgtccagcagggggtcctccagatgtgagctggctaccaatcctgtgtcaggctgcagacttgccatgtccttgaacacctttgcacctctgcacatggtctcatctctttctcctgtagctcgccagctgaggtcctattcacactttctttctttctgagtcagaatccctgtcccccaggctgcagtgcaatgccgtgatcatggttcactgtggcctcaaacttccaggctcaagtgatcctcccacctcagcctccagagtagtcgaaaccagaggcttgtgcgaccacacccggctaatttttttattttttgaagagacagggttttgccatgttgcccaggctggtcttgaattcctgggctcaagcggtctgcctgcctcaggattcctattcactctttacaatccagctctgctgcacccctgagcttctggagatgccacagaacacttgtctgtgctcctttgtggcactcaccacgttttgttaaaatgaccaatcgccctccttgacagggttgtgtgctgcttgagggcaggggctgtctcattcacgtggaggttcaacacatgtctgtggaatgggtttcgctgccccaaagctgattctatcttttgctgtgtttgcattggaacaatgggcagaaatgatttcctaattctgcttgcatggggtaggtcagacaacttggatgtgggttttagttctgggtcttatacttcaaatgatgcagggcagagtgatcccacgccagggcaagctgggtgctaaaggatttaggcgctctatcacaagaggaacaggaaaaaagaaggcttaggtggggaatacgagagctgtcttcaaacatctgggagaatgtcctgtgttccctcaccgtctaaggctcagggacttcttcccagaacaggatggagccctggacacacaactacacacacaaacaattgtcacagagtgggaggcaggataaagtggtgagtaacagcctggcctgagacacaggctcacgcatctgacactggctgagccgcgcactagctgagtggccttgggcatgttttgtaacctccttgactgttcccttatctgtgaaattgagataaatgtactacccacttcataaaaagatcaaatgtgataatacttgaaatatgtttagaacaaagttggccatattcaataaatgttagcttaaaaaaaaaaca

SEQ ID NO: 737208 - DNA, 1019 bp, Homo sapiens; identical to SEQ ID NO: 101446

SEQ ID NO: 737209 - DNA, 920 bp, Homo sapiens; identical to SEQ ID NO: 8329

SEQ ID NO: 737210 - DNA, 439 bp, Homo sapiens
cttcgggacagctgcaactcacaaccagtcttttgttgaccttcagctgatttcccaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaagtctgtgagtcttcaatgaaagcctctgtctagaaccccgagtgttgatctgtctcccctctgccttggtcagaggccctgctttctcat

SEQ ID NO: 737211 - DNA, 433 bp, Homo sapiens
tcaagcttctaacgatgtacggggacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaagtctgtgagtcttcaatgaaagcctctgtctagaaccccgagtgttgatctgtctcccctctgccttggtcagaggccctgctttctcat

SEQ ID NO: 737212 - DNA, 576 bp, Homo sapiens
ctataccaccctataccaccctatacaccataccacacgtctcatggaggtagtgcttttcttatacctcagcgctaatgaggactgtcctccgcaccggtggtatagctgataaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaagtctgtgagtcttcaatgaaagcctctgtctagaaccccgagtgttgatctgtctcccctctgccttggtcagaggccctgctttctcat

SEQ ID NO: 737213 - DNA, 488 bp, Homo sapiens
cgcgaacgcgtgggcggacggtgggtaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaagtctgtgagtcttcaatgaaagcctctgtctagaaccccgagtgttgatctgtctcccctctgccttggtcagaggccctgctttctcat

SEQ ID NO: 737214 - DNA, 674 bp, Homo sapiens
caagaattcggcacgagggttaccattctgatgttggagcggccgcagatcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaagtctgtgagtcttcaatgaaagcctctgtctagaaccccgagtgttgatctgtctcccctctgccttggtcagaggccctgctttctcat

SEQ ID NO: 737215 - DNA, 890 bp, Homo sapiens
tagaggatcgcttagagacacatgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaagtctgtgagtcttcaatgaaagcctctgtctagaaccccgagtgttgatctgtctcccctctgccttggtcagaggccctgctttctcat

SEQ ID NO: 737216 - DNA, 534 bp, Homo sapiens
catgtaaatatgacctcagacaaaaaggaaccagaggcccaagggcaataataaggtggaatttgcaggtcagcccaggaattggcagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaagtctgtgagtcttcaatgaaagcctctgtctagaaccccgagtgttgatctgtctcccctctgccttggtcagaggccctgctttctcat

SEQ ID NO: 737217 - DNA, 3548 bp, Homo sapiens
  misc_feature (56)..(56): n is a, c, g, or t
caaccccatcctctgcccctccccccttccgcccacgccatgggtaggcaaagggnccggaattttcaaaacagcgtcgacccacgcgtctttacctgacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaagtctgtgagtcttcaatgaaagcctctgtctagaaccccgagtgttgatctgtctcccctctgccttggtcagaggccctgctttctcat

SEQ ID NO: 737218 - DNA, 1088 bp, Homo sapiens
catgtaaatatgacctcagacaaaaaggaaccagaggcccaagggcaataataaggtggaatttgcaggtcagcccaggaattggcagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaagtctgtgagtcttcaatgaaagcctctgtctagaaccccgagtgttgatctgtctcccctctgccttggtcagaggccctgctttctcat

SEQ ID NO: 737219 - DNA, 3281 bp, Homo sapiens
catgtaaatatgacctcagacaaaaaggaaccagaggcccaagggcaataataaggtggaatttgcaggtcagcccaggaattggcagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacatgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccacatttttcaagaatttctctataatccccatgttctaagccttgaaaatcatattcaggttcctttttgtaaagaagattttcccatgcatttgctatggttatttgttttacttcttcccaactttttgcccagttaaaaattgcactttttatattgtagattttaattttggaaactcctttatctcctttctcttgctcatcatcactttcttcaaatattacaagactctcttcaagttgcttccatctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatgattgactttaatttatgagttccgtctgcatttgcacataaaaaggcagacaacctttctttgtttattttcttccctggtaggcagatatctttcctacttgcctgagaattttctggcattgacttccaaaagaggtctgtttcatccccactgtatagctgagctagacacagtttctcctctttgattatcatggacagtttttgtcgaaatggctcaacattttcagaaactgaacttaggacttgttccccacatccttttcggttcccaattgcatgccgatttcgaaatctaaaaagccaaccagtgctagctttgaaatctgttcgcccaaaacaccgtgcaaatctctctgcagcagcctgaagctccacgcctcttaccggaacaccggctgagcgtttctgttggtaccacatgtagaccgcatcatctacatcaccatatttggctcccgttgtcctctttctcttctcagcccctactaatggcatgtcctgcttcagtacaaagtccagaattaacttcttattttttttaatgtcataaaatgttgacttactgattccaaattcatccattacacttttaagtgatcgtccagcttcaattctacttagaaccttcattttctcctccaaattcagtgttgtatatttccctctcttattcatactgaatttaactctgaaccaccaacaggagaaaacaaagggaaaagccttaatgaattggcaaaaaaaaaacccacattttttaaacaaaacttagctgaaagccccagaaggcatgggcattgtattggaggataatggactgaaggggctaaccatgactgaagagctagtctagaggtggaggtcttatgcactcagaaagctgccagttgcaaagtcctgtctggctcttgctcctgcaagccatgagtgatcatttttcagaatgccccctacctctcctctcttttgacagatacaacagcctcagtcaggaatgacaggaatacctgcatactttccctaactcaataccggaaaacggacaatatgaagagaggagggatggagcaagatgtgcccacaagacaggtgtgataagtttccataaaaactgatgcttcagaagaagggagcgtgaaagactcaaaggcaatgacagagtaatcttgtgtgtagcagagatgcaatgtggcttctccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtgctttaacttgaatgtctcttgtgtttgccaaggtaatatgtaagtatgtaaataatttatttgtcagtggcactttaccattctcagatcttctttcttgggaacatctgatttattctcaagtgctatttttcactgaaactgttctctatttgagatattatcaaagtttcagaatcacagcaattctcagagatgagcccaaaagttttacaaatatttcaccatagttaaaaatttttaaagatctgtcctttcatttgttttcctaaatttacactataagtaacatactttttatatttgagattttgatttctcttcagtgtttattttacttaatttgaaccaagactcaacttttccacagaagaaatctaaaaggtttctctgctgctgtttctgatcaattgtttctcataaatcctactggcaaactcttctgtccctctaggccctcaaatactcttttcgggtcctcctggtgctccccaaagccattccaggtccttagaaatgtcttagtctagattaatttcctggttctcagtccagatacacaacctcatgggaagaaacaaaaactgccacttttatccattccaggtgctacgaagaaagaaaagtatgtcagagaaataagggaaatggctggtatctcagttattcttcctcttctttagggcagaatctgactggcccattcattcctcaactac

SEQ ID NO: 737220 - DNA, 5792 bp, Homo sapiens
catgtaaatatgacctcagacaaaaaggaaccagaggcccaagggcaataataaggtggaatttgcaggtcagcccaggaattggcagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacatgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccacatttttcaagaatttctctataatccccatgttctaagccttgaaaatcatattcaggttcctttttgtaaagaagattttcccatgcatttgctatggttatttgttttacttcttcccaactttttgcccagttaaaaattgcactttttatattgtagattttaattttggaaactcctttatctcctttctcttgctcatcatcactttcttcaaatattacaagactctcttcaagttgcttccatctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatgattgactttaatttatgagttccgtctgcatttgcacataaaaaggcagacaacctttctttgtttattttcttccctggtaggcagatatctttcctacttgcctgagaattttctggcattgacttccaaaagaggtctgtttcatccccactgtatagctgagctagacacagtttctcctctttgattatcatggacagtttttgtcgaaatggctcaacattttcagaaactgaacttaggacttgttccccacatccttttcggttcccaattgcatgccgatttcgaaatctaaaaagccaaccagtgctagctttgaaatctgttcgcccaaaacaccgtgcaaatctctctgcagcagcctgaagctccacgcctcttaccggaacaccggctgagcgtttctgttggtaccacatgtagaccgcatcatctacatcaccatatttggctcccgttgtcctctttctcttctcagcccctactaatggcatgtcctgcttcagtacaaagtccagaattaacttcttattttttttaatgtcataaaatgttgacttactgattccaaattcatccattacacttttaagtgatcgtccagcttcaattctacttagaaccttcattttctcctccaaattcagtgttgtatatttccctctcttattcatactgaatttaactctgaaccaccaacaggagaaaacaaagggaaaagccttaatgaattggcaaaaaaaaaacccacattttttaaacaaaacttagctgaaagccccagaaggcatgggcattgtattggaggataatggactgaaggggctaaccatgactgaagagctagtctagaggtggaggtcttatgcactcagaaagctgccagttgcaaagtcctgtctggctcttgctcctgcaagccatgagtgatcatttttcagaatgccccctacctctcctctcttttgacagatacaacagcctcagtcaggaatgacaggaatacctgcatactttccctaactcaataccggaaaacggacaatatgaagagaggagggatggagcaagatgtgcccacaagacaggtgtgataagtttccataaaaactgatgcttcagaagaagggagcgtgaaagactcaaaggcaatgacagagtaatcttgtgtgtagcagagatgcaatgtggcttctccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtgctttaacttgaatgtctcttgtgtttgccaaggtaatatgtaagtatgtaaataatttatttgtcagtggcactttaccattctcagatcttctttcttgggaacatctgatttattctcaagtgctatttttcactgaaactgttctctatttgagatattatcaaagtttcagaatcacagcaattctcagagatgagcccaaaagttttacaaatatttcaccatagttaaaaatttttaaagatctgtcctttcatttgttttcctaaatttacactataagtaacatactttttatatttgagattttgatttctcttcagtgtttattttacttaatttgaaccaagactcaacttttccacagaagaaatctaaaaggtttctctgctgctgtttctgatcaattgtttctcataaatcctactggcaaactcttctgtccctctaggccctcaaatactcttttcgggtcctcctggtgctccccaaagccattccaggtccttagaaatgtcttagtctagattaatttcctggttctcagtccagatacacaacctcatgggaagaaacaaaaactgccacttttatccattccaggtgccggcgaggctcccgggaccaaacgccgcccgacagccacgcagaacagacgtggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcacagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatggaatatatattagatgtaaagaattttctgcaataaaagaaactagacttgttaatccctgccttgcaatgtcagtaggataaagcagctataaaaattagtacttgcccaaggcctgaaagagaattagtgggaattaagatcaacttctcagttttgtttgtttactttttaattggcttttctttgttgttaagaatgagagacttaatttccatgggagttggagtgtgtgtgctgcaggcaggatcctgtggctcatttggcatggagacctggacatgtagtcagcaggagacggttccctaaataaaagatttgggcactggtg

SEQ ID NO: 737221 - DNA, 3402 bp, Homo sapiens
catgtaaatatgacctcagacaaaaaggaaccagaggcccaagggcaataataaggtggaatttgcaggtcagcccaggaattggcagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacatgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccacatttttcaagaatttctctataatccccatgttctaagccttgaaaatcatattcaggttcctttttgtaaagaagattttcccatgcatttgctatggttatttgttttacttcttcccaactttttgcccagttaaaaattgcactttttatattgtagattttaattttggaaactcctttatctcctttctcttgctcatcatcactttcttcaaatattacaagactctcttcaagttgcttccatctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatgattgactttaatttatgagttccgtctgcatttgcacataaaaaggcagacaacctttctttgtttattttcttccctggtaggcagatatctttcctacttgcctgagaattttctggcattgacttccaaaagaggtctgtttcatccccactgtatagctgagctagacacagtttctcctctttgattatcatggacagtttttgtcgaaatggctcaacattttcagaaactgaacttaggacttgttccccacatccttttcggttcccaattgcatgccgatttcgaaatctaaaaagccaaccagtgctagctttgaaatctgttcgcccaaaacaccgtgcaaatctctctgcagcagcctgaagctccacgcctcttaccggaacaccggctgagcgtttctgttggtaccacatgtagaccgcatcatctacatcaccatatttggctcccgttgtcctctttctcttctcagcccctactaatggcatgtcctgcttcagtacaaagtccagaattaacttcttattttttttaatgtcataaaatgttgacttactgattccaaattcatccattacacttttaagtgatcgtccagcttcaattctacttagaaccttcattttctcctccaaattcagtgttgtatatttccctctcttattcatactgaatttaactctgaaccaccaacaggagaaaacaaagggaaaagccttaatgaattggcaaaaaaaaaacccacattttttaaacaaaacttagctgaaagccccagaaggcatgggcattgtattggaggataatggactgaaggggctaaccatgactgaagagctagtctagaggtggaggtcttatgcactcagaaagctgccagttgcaaagtcctgtctggctcttgctcctgcaagccatgagtgatcatttttcagaatgccccctacctctcctctcttttgacagatacaacagcctcagtcaggaatgacaggaatacctgcatactttccctaactcaataccggaaaacggacaatatgaagagaggagggatggagcaagatgtgcccacaagacaggtgtgataagtttccataaaaactgatgcttcagaagaagggagcgtgaaagactcaaaggcaatgacagagtaatcttgtgtgtagcagagatgcaatgtggcttctccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtgctttaacttgaatgtctcttgtgtttgccaaggtaatatgtaagtatgtaaataatttatttgtcagtggcactttaccattctcagatcttctttcttgggaacatctgatttattctcaagtgctatttttcactgaaactgttctctatttgagatattatcaaagtttcagaatcacagcaattctcagagatgagcccaaaagttttacaaatatttcaccatagttaaaaatttttaaagatctgtcctttcatttgttttcctaaatttacactataagtaacatactttttatatttgagattttgatttctcttcagtgtttattttacttaatttgaaccaagactcaacttttccacagaagaaatctaaaaggtttctctgctgctgtttctgatcaattgtttctcataaatcctactggcaaactcttctgtccctctaggccctcaaatactcttttcgggtcctcctggtgctccccaaagccattccaggtccttagaaatgtcttagtctagattaatttcctggttctcagtccagatacacaacctcatgggaagaaacaaaaactgccacttttatccattccaggtgccggcgaggctcccgggaccaaacgccgcccgacagccacgcagaacagacgtggcagtgcgacgcctcccccactggggacacgagacagcgacagccacgcggtgagccggtacaaggccctctaggcttcagcgggtctggatactcggtggcattaacccttccctaccgccggggaagacagcagtttctacggacgcggggtcgacgatatcccgaaatccgacc

SEQ ID NO: 737222 - DNA, 6203 bp, Homo sapiens
catgtaaatatgacctcagacaaaaaggaaccagaggcccaagggcaataataaggtggaatttgcaggtcagcccaggaattggcagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacatgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccacatttttcaagaatttctctataatccccatgttctaagccttgaaaatcatattcaggttcctttttgtaaagaagattttcccatgcatttgctatggttatttgttttacttcttcccaactttttgcccagttaaaaattgcactttttatattgtagattttaattttggaaactcctttatctcctttctcttgctcatcatcactttcttcaaatattacaagactctcttcaagttgcttccatctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatgattgactttaatttatgagttccgtctgcatttgcacataaaaaggcagacaacctttctttgtttattttcttccctggtaggcagatatctttcctacttgcctgagaattttctggcattgacttccaaaagaggtctgtttcatccccactgtatagctgagctagacacagtttctcctctttgattatcatggacagtttttgtcgaaatggctcaacattttcagaaactgaacttaggacttgttccccacatccttttcggttcccaattgcatgccgatttcgaaatctaaaaagccaaccagtgctagctttgaaatctgttcgcccaaaacaccgtgcaaatctctctgcagcagcctgaagctccacgcctcttaccggaacaccggctgagcgtttctgttggtaccacatgtagaccgcatcatctacatcaccatatttggctcccgttgtcctctttctcttctcagcccctactaatggcatgtcctgcttcagtacaaagtccagaattaacttcttattttttttaatgtcataaaatgttgacttactgattccaaattcatccattacacttttaagtgatcgtccagcttcaattctacttagaaccttcattttctcctccaaattcagtgttgtatatttccctctcttattcatactgaatttaactctgaaccaccaacaggagaaaacaaagggaaaagccttaatgaattggcaaaaaaaaaacccacattttttaaacaaaacttagctgaaagccccagaaggcatgggcattgtattggaggataatggactgaaggggctaaccatgactgaagagctagtctagaggtggaggtcttatgcactcagaaagctgccagttgcaaagtcctgtctggctcttgctcctgcaagccatgagtgatcatttttcagaatgccccctacctctcctctcttttgacagatacaacagcctcagtcaggaatgacaggaatacctgcatactttccctaactcaataccggaaaacggacaatatgaagagaggagggatggagcaagatgtgcccacaagacaggtgtgataagtttccataaaaactgatgcttcagaagaagggagcgtgaaagactcaaaggcaatgacagagtaatcttgtgtgtagcagagatgcaatgtggcttctccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtgctttaacttgaatgtctcttgtgtttgccaaggtaatatgtaagtatgtaaataatttatttgtcagtggcactttaccattctcagatcttctttcttgggaacatctgatttattctcaagtgctatttttcactgaaactgttctctatttgagatattatcaaagtttcagaatcacagcaattctcagagatgagcccaaaagttttacaaatatttcaccatagttaaaaatttttaaagatctgtcctttcatttgttttcctaaatttacactataagtaacatactttttatatttgagattttgatttctcttcagtgtttattttacttaatttgaaccaagactcaacttttccacagaagaaatctaaaaggtttctctgctgctgtttctgatcaattgtttctcataaatcctactggcaaactcttctgtccctctaggccctcaaatactcttttcgggtcctcctggtgctccccaaagccattccaggtccttagaaatgtcttagtctagattaatttcctggttctcagtccagatacacaacctcatgggaagaaacaaaaactgccacttttatccattccaggtgcttagatgaactgccatagaaagcagctcagtccaaaacgctcaaatggtgctccaggatttacttttttgtattgttttgttttgttttttgcgacggagtctcgctctgtcgcccaggctggaatgcagtggcgtgaactcggctcactgcaagctccgcctcccgggttcacgccattctcctgcctcagcctcccgagtagctgggactacaggcgcccaccaccacgcccggctaatttttttttgtattttttagtagagacggggtttcaccatgttagccaggatggtctcgatctcctgacctcatgatccgcccgcctcggcctcccaaagtgctgggattacaggcgtaagccaccgcgcccggccaggatttactttcttaaatgcactcttttcattcccattcaaaggactccagtataagtgccacataaactcgttttctaacttttaaaactcttcctctaaatgcagcccaactcagtaaaaacgtacctaagatctcacagtctaatgtttccagcttttaaagcctttactcctacccttccctctgcctggaaagtgtctccattccctgctgtggacaaaatccctcaaggtcttttataatttcccccaaccccaaatcaacttggattttcttggagttctcacagcattcagtttatgtcctattcttacccttgtgttactgatattcacgaaattgctcagtcctttcaagagattgcttaaggacaaagacttcttactcaactctgcaatattggctacacatagctgacttaataaatagtcccttgactggtataagctgacgttacaaaaactggtaattccgaaaccactcatactggacttattaaataatccctcaactggtacagactgacattacaaaaacggattaattcagagatcactgaacacccaaaacactcagattcttataactatgattcagtaaatatgtgtggaatgcctatcttaccaggtgactatgttaggcgctgcatgagatataagatgaaaacaaggttcccattttccagggaagaatactggagtggaaaacgcagaggataccacaacaggagagctatttccgattagcggccgccactgctgagctatgtgaccctgagcaagtcacttcttaggtctccgtttctctgtcaaggagagatagaaaaagaacctatttcacaggttcaaacctacctcaagaaaaaatagttgtggggaatgcgtcacgagacctagaaaacggtacaaaaccctcggggggccgctgtttctgacctagcgagtggcccgacccggacaaaatgcctcttcctcgaggaggcggcgacgagcccagcaacagctcgagcacggccggccgggccgcgggaagcccgagaacgcggcgcgcgcagctgggaggcgacccttacccggcgaggctcccgggaccaaacgccgcccgacagccacgcagaacagacgtggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgagtgcttttaggaagaagatccttttattgcttttgtacaagaccagacaggatctcatttgttaaacgtggtaccaattgggtgtcttaacacaggagcagaacttcctagagcagaatgatgatggtagatctgaaagtggctgcgtacttggaccctcagatcagggctttgtgggagaccaaggggcctgcaagagagagctccggtcagagtaaaaaatctcctcaaatggactgtctcgatcctaagagctcttgctggcacttccggaatttcacctatgatgaagcaggtggaccccgtgaggctgtcagcaaacttcaagaattatgtcatctatggctgaagccagagatccactcaaaagagcagatactggaactgctggtgctggagcagttcctgactattctgcccagggagacacagacccagatgcagaagcaccatccacagagcattgaggaggctgtggctctggtagaacacttgcagagggaatctggtcaaacatggaatggggtgagaagaaagattcctgacatgtacagtgaaataggatgcaggtggatatagtagagatggtggcagttagttgagaaattagatggattaggtaggtcattgttggttttcttcttaaggacagttaaggtgggacttgaaactacaggcccacagaaaagttcacaggtttcagagattgtggtagatacttccctggccttagagaaagagagttgcttttgccctctttggagccagggtgaattgagggtgttgggcctagtctggcttggccaaggagacaggacttaagtacttagaaacagaataaaaggtaataaagagtcagggaggctggatgcagtggctcacacctgtaatctcagcactttaggaggctgaggcgggtagatcacctgaggtcaggagttcaagaccagcctggacagcatggtggaaccctctctctacaaaaataaacaaattagctgggcatgatgaccggtgcctgtaatcccggctatcctcgaggctgaggagggagaatcatttgaacctgggaggttgcagtgagccgagatcgcaccattgcactccagcctgggcaacacagcaagactccatctcacaaaaaaaaa

SEQ ID NO: 737223 - DNA, 6136 bp, Homo sapiens
catgtaaatatgacctcagacaaaaaggaaccagaggcccaagggcaataataaggtggaatttgcaggtcagcccaggaattggcagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacatgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccacatttttcaagaatttctctataatccccatgttctaagccttgaaaatcatattcaggttcctttttgtaaagaagattttcccatgcatttgctatggttatttgttttacttcttcccaactttttgcccagttaaaaattgcactttttatattgtagattttaattttggaaactcctttatctcctttctcttgctcatcatcactttcttcaaatattacaagactctcttcaagttgcttccatctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatgattgactttaatttatgagttccgtctgcatttgcacataaaaaggcagacaacctttctttgtttattttcttccctggtaggcagatatctttcctacttgcctgagaattttctggcattgacttccaaaagaggtctgtttcatccccactgtatagctgagctagacacagtttctcctctttgattatcatggacagtttttgtcgaaatggctcaacattttcagaaactgaacttaggacttgttccccacatccttttcggttcccaattgcatgccgatttcgaaatctaaaaagccaaccagtgctagctttgaaatctgttcgcccaaaacaccgtgcaaatctctctgcagcagcctgaagctccacgcctcttaccggaacaccggctgagcgtttctgttggtaccacatgtagaccgcatcatctacatcaccatatttggctcccgttgtcctctttctcttctcagcccctactaatggcatgtcctgcttcagtacaaagtccagaattaacttcttattttttttaatgtcataaaatgttgacttactgattccaaattcatccattacacttttaagtgatcgtccagcttcaattctacttagaaccttcattttctcctccaaattcagtgttgtatatttccctctcttattcatactgaatttaactctgaaccaccaacaggagaaaacaaagggaaaagccttaatgaattggcaaaaaaaaaacccacattttttaaacaaaacttagctgaaagccccagaaggcatgggcattgtattggaggataatggactgaaggggctaaccatgactgaagagctagtctagaggtggaggtcttatgcactcagaaagctgccagttgcaaagtcctgtctggctcttgctcctgcaagccatgagtgatcatttttcagaatgccccctacctctcctctcttttgacagatacaacagcctcagtcaggaatgacaggaatacctgcatactttccctaactcaataccggaaaacggacaatatgaagagaggagggatggagcaagatgtgcccacaagacaggtgtgataagtttccataaaaactgatgcttcagaagaagggagcgtgaaagactcaaaggcaatgacagagtaatcttgtgtgtagcagagatgcaatgtggcttctccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtgctttaacttgaatgtctcttgtgtttgccaaggtaatatgtaagtatgtaaataatttatttgtcagtggcactttaccattctcagatcttctttcttgggaacatctgatttattctcaagtgctatttttcactgaaactgttctctatttgagatattatcaaagtttcagaatcacagcaattctcagagatgagcccaaaagttttacaaatatttcaccatagttaaaaatttttaaagatctgtcctttcatttgttttcctaaatttacactataagtaacatactttttatatttgagattttgatttctcttcagtgtttattttacttaatttgaaccaagactcaacttttccacagaagaaatctaaaaggtttctctgctgctgtttctgatcaattgtttctcataaatcctactggcaaactcttctgtccctctaggccctcaaatactcttttcgggtcctcctggtgctccccaaagccattccaggtccttagaaatgtcttagtctagattaatttcctggttctcagtccagatacacaacctcatgggaagaaacaaaaactgccacttttatccattccaggtgcttagatgaactgccatagaaagcagctcagtccaaaacgctcaaatggtgctccaggatttacttttttgtattgttttgttttgttttttgcgacggagtctcgctctgtcgcccaggctggaatgcagtggcgtgaactcggctcactgcaagctccgcctcccgggttcacgccattctcctgcctcagcctcccgagtagctgggactacaggcgcccaccaccacgcccggctaatttttttttgtattttttagtagagacggggtttcaccatgttagccaggatggtctcgatctcctgacctcatgatccgcccgcctcggcctcccaaagtgctgggattacaggcgtaagccaccgcgcccggccaggatttactttcttaaatgcactcttttcattcccattcaaaggactccagtataagtgccacataaactcgttttctaacttttaaaactcttcctctaaatgcagcccaactcagtaaaaacgtacctaagatctcacagtctaatgtttccagcttttaaagcctttactcctacccttccctctgcctggaaagtgtctccattccctgctgtggacaaaatccctcaaggtcttttataatttcccccaaccccaaatcaacttggattttcttggagttctcacagcattcagtttatgtcctattcttacccttgtgttactgatattcacgaaattgctcagtcctttcaagagattgcttaaggacaaagacttcttactcaactctgcaatattggctacacatagctgacttaataaatagtcccttgactggtataagctgacgttacaaaaactggtaattccgaaaccactcatactggacttattaaataatccctcaactggtacagactgacattacaaaaacggattaattcagagatcactgaacacccaaaacactcagattcttataactatgattcagtaaatatgtgtggaatgcctatcttaccaggtgactatgttaggcgctgcatgagatataagatgaaaacaaggttcccattttccagggaagaatactggagtggaaaacgcagaggataccacaacaggagagctatttccgattagcggccgccactgctgagctatgtgaccctgagcaagtcacttcttaggtctccgtttctctgtcaaggagagatagaaaaagaacctatttcacaggttcaaacctacctcaagaaaaaatagttgtggggaatgcgtcacgagacctagaaaacggtacaaaaccctcggggggccgctgtttctgacctagcgagtggcccgacccggacaaaatgcctcttcctcgaggaggcggcgacgagcccagcaacagctcgagcacggccggccgggccgcgggaagcccgagaacgcggcgcgcgcagctgggaggcgacccttacccggcgaggctcccgggaccaaacgccgcccgacagccacgcagaacagacgtggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgagtgcttttaggaagaagatccttttattgcttttgtacaagaccagacaggatctcatttgttaaacgtggtaccaattgggtgtcttaacacaggagcagaacttcctagagcagaatgatgatggtagatctgaaagtggctgcgtacttggaccctcagatcagggctttgtgggagaccaaggggcctgcaagagagagctccggtcagagtaaaaaatctcctcaaatggactgtctcgatcctaagagctcttgctggcacttccggaatttcacctatgatgaagcaggtggaccccgtgaggctgtcagcaaacttcaagaattatgtcatctatggctgaagccagagatccactcaaaagagcagatactggaactgctggtgctggagcagttcctgactattctgcccagggagacacagacccagatgcagaagcaccatccacagagcattgaggaggctgtggctctggtagaacacttgcagagggaatctggtcaaacatggaatggggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccaggtgagctgtgctttccagctgttgagggctacctttctctgctatgtatgattaatactgtccaggaggggttcagaggtgtgttagtcccgggtgttctctgggcaactgggtacctcccaggctgtgggctgacgccttttctcctttttttctgccttctcacttaaaaaaatcatgttctgttaattcctttatcgcctggccaattcatagccaggtggctaggctgcttctgtacagtggcaggttctgagctgaagtccat

SEQ ID NO: 737224 - DNA, 7769 bp, Homo sapiens
catgtaaatatgacctcagacaaaaaggaaccagaggcccaagggcaataataaggtggaatttgcaggtcagcccaggaattggcagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacatgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccacatttttcaagaatttctctataatccccatgttctaagccttgaaaatcatattcaggttcctttttgtaaagaagattttcccatgcatttgctatggttatttgttttacttcttcccaactttttgcccagttaaaaattgcactttttatattgtagattttaattttggaaactcctttatctcctttctcttgctcatcatcactttcttcaaatattacaagactctcttcaagttgcttccatctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatgattgactttaatttatgagttccgtctgcatttgcacataaaaaggcagacaacctttctttgtttattttcttccctggtaggcagatatctttcctacttgcctgagaattttctggcattgacttccaaaagaggtctgtttcatccccactgtatagctgagctagacacagtttctcctctttgattatcatggacagtttttgtcgaaatggctcaacattttcagaaactgaacttaggacttgttccccacatccttttcggttcccaattgcatgccgatttcgaaatctaaaaagccaaccagtgctagctttgaaatctgttcgcccaaaacaccgtgcaaatctctctgcagcagcctgaagctccacgcctcttaccggaacaccggctgagcgtttctgttggtaccacatgtagaccgcatcatctacatcaccatatttggctcccgttgtcctctttctcttctcagcccctactaatggcatgtcctgcttcagtacaaagtccagaattaacttcttattttttttaatgtcataaaatgttgacttactgattccaaattcatccattacacttttaagtgatcgtccagcttcaattctacttagaaccttcattttctcctccaaattcagtgttgtatatttccctctcttattcatactgaatttaactctgaaccaccaacaggagaaaacaaagggaaaagccttaatgaattggcaaaaaaaaaacccacattttttaaacaaaacttagctgaaagccccagaaggcatgggcattgtattggaggataatggactgaaggggctaaccatgactgaagagctagtctagaggtggaggtcttatgcactcagaaagctgccagttgcaaagtcctgtctggctcttgctcctgcaagccatgagtgatcatttttcagaatgccccctacctctcctctcttttgacagatacaacagcctcagtcaggaatgacaggaatacctgcatactttccctaactcaataccggaaaacggacaatatgaagagaggagggatggagcaagatgtgcccacaagacaggtgtgataagtttccataaaaactgatgcttcagaagaagggagcgtgaaagactcaaaggcaatgacagagtaatcttgtgtgtagcagagatgcaatgtggcttctccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtgctttaacttgaatgtctcttgtgtttgccaaggtaatatgtaagtatgtaaataatttatttgtcagtggcactttaccattctcagatcttctttcttgggaacatctgatttattctcaagtgctatttttcactgaaactgttctctatttgagatattatcaaagtttcagaatcacagcaattctcagagatgagcccaaaagttttacaaatatttcaccatagttaaaaatttttaaagatctgtcctttcatttgttttcctaaatttacactataagtaacatactttttatatttgagattttgatttctcttcagtgtttattttacttaatttgaaccaagactcaacttttccacagaagaaatctaaaaggtttctctgctgctgtttctgatcaattgtttctcataaatcctactggcaaactcttctgtccctctaggccctcaaatactcttttcgggtcctcctggtgctccccaaagccattccaggtccttagaaatgtcttagtctagattaatttcctggttctcagtccagatacacaacctcatgggaagaaacaaaaactgccacttttatccattccaggtgcttagatgaactgccatagaaagcagctcagtccaaaacgctcaaatggtgctccaggatttacttttttgtattgttttgttttgttttttgcgacggagtctcgctctgtcgcccaggctggaatgcagtggcgtgaactcggctcactgcaagctccgcctcccgggttcacgccattctcctgcctcagcctcccgagtagctgggactacaggcgcccaccaccacgcccggctaatttttttttgtattttttagtagagacggggtttcaccatgttagccaggatggtctcgatctcctgacctcatgatccgcccgcctcggcctcccaaagtgctgggattacaggcgtaagccaccgcgcccggccaggatttactttcttaaatgcactcttttcattcccattcaaaggactccagtataagtgccacataaactcgttttctaacttttaaaactcttcctctaaatgcagcccaactcagtaaaaacgtacctaagatctcacagtctaatgtttccagcttttaaagcctttactcctacccttccctctgcctggaaagtgtctccattccctgctgtggacaaaatccctcaaggtcttttataatttcccccaaccccaaatcaacttggattttcttggagttctcacagcattcagtttatgtcctattcttacccttgtgttactgatattcacgaaattgctcagtcctttcaagagattgcttaaggacaaagacttcttactcaactctgcaatattggctacacatagctgacttaataaatagtcccttgactggtataagctgacgttacaaaaactggtaattccgaaaccactcatactggacttattaaataatccctcaactggtacagactgacattacaaaaacggattaattcagagatcactgaacacccaaaacactcagattcttataactatgattcagtaaatatgtgtggaatgcctatcttaccaggtgactatgttaggcgctgcatgagatataagatgaaaacaaggttcccattttccagggaagaatactggagtggaaaacgcagaggataccacaacaggagagctatttccgattagcggccgccactgctgagctatgtgaccctgagcaagtcacttcttaggtctccgtttctctgtcaaggagagatagaaaaagaacctatttcacaggttcaaacctacctcaagaaaaaatagttgtggggaatgcgtcacgagacctagaaaacggtacaaaaccctcggggggccgctgtttctgacctagcgagtggcccgacccggacaaaatgcctcttcctcgaggaggcggcgacgagcccagcaacagctcgagcacggccggccgggccgcgggaagcccgagaacgcggcgcgcgcagctgggaggcgacccttacccggcgaggctcccgggaccaaacgccgcccgacagccacgcagaacagacgtggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgagtgcttttaggaagaagatccttttattgcttttgtacaagaccagacaggatctcatttgttaaacgtggtaccaattgggtgtcttaacacaggagcagaacttcctagagcagaatgatgatggtagatctgaaagtggctgcgtacttggaccctcagatcagggctttgtgggagaccaaggggcctgcaagagagagctccggtcagagtaaaaaatctcctcaaatggactgtctcgatcctaagagctcttgctggcacttccggaatttcacctatgatgaagcaggtggaccccgtgaggctgtcagcaaacttcaagaattatgtcatctatggctgaagccagagatccactcaaaagagcagatactggaactgctggtgctggagcagttcctgactattctgcccagggagacacagacccagatgcagaagcaccatccacagagcattgaggaggctgtggctctggtagaacacttgcagagggaatctggtcaaacatggaatggggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcacagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatggaatatatattagatgtaaagaattttctgcaataaaagaaactagacttgttaatccctgccttgcaatgtcagtaggataaagcagctataaaaattagtacttgcccaaggcctgaaagagaattagtgggaattaagatcaacttctcagttttgtttgtttactttttaattggcttttctttgttgttaagaatgagagacttaatttccatgggagttggagtgtgtgtgctgcaggcaggatcctgtggctcatttggcatggagacctggacatgtagtcagcaggagacggttccctaaataaaagatttgggcactggtg

SEQ ID NO: 737225 - DNA, 7245 bp, Homo sapiens
catgtaaatatgacctcagacaaaaaggaaccagaggcccaagggcaataataaggtggaatttgcaggtcagcccaggaattggcagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacatgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccacatttttcaagaatttctctataatccccatgttctaagccttgaaaatcatattcaggttcctttttgtaaagaagattttcccatgcatttgctatggttatttgttttacttcttcccaactttttgcccagttaaaaattgcactttttatattgtagattttaattttggaaactcctttatctcctttctcttgctcatcatcactttcttcaaatattacaagactctcttcaagttgcttccatctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatgattgactttaatttatgagttccgtctgcatttgcacataaaaaggcagacaacctttctttgtttattttcttccctggtaggcagatatctttcctacttgcctgagaattttctggcattgacttccaaaagaggtctgtttcatccccactgtatagctgagctagacacagtttctcctctttgattatcatggacagtttttgtcgaaatggctcaacattttcagaaactgaacttaggacttgttccccacatccttttcggttcccaattgcatgccgatttcgaaatctaaaaagccaaccagtgctagctttgaaatctgttcgcccaaaacaccgtgcaaatctctctgcagcagcctgaagctccacgcctcttaccggaacaccggctgagcgtttctgttggtaccacatgtagaccgcatcatctacatcaccatatttggctcccgttgtcctctttctcttctcagcccctactaatggcatgtcctgcttcagtacaaagtccagaattaacttcttattttttttaatgtcataaaatgttgacttactgattccaaattcatccattacacttttaagtgatcgtccagcttcaattctacttagaaccttcattttctcctccaaattcagtgttgtatatttccctctcttattcatactgaatttaactctgaaccaccaacaggagaaaacaaagggaaaagccttaatgaattggcaaaaaaaaaacccacattttttaaacaaaacttagctgaaagccccagaaggcatgggcattgtattggaggataatggactgaaggggctaaccatgactgaagagctagtctagaggtggaggtcttatgcactcagaaagctgccagttgcaaagtcctgtctggctcttgctcctgcaagccatgagtgatcatttttcagaatgccccctacctctcctctcttttgacagatacaacagcctcagtcaggaatgacaggaatacctgcatactttccctaactcaataccggaaaacggacaatatgaagagaggagggatggagcaagatgtgcccacaagacaggtgtgataagtttccataaaaactgatgcttcagaagaagggagcgtgaaagactcaaaggcaatgacagagtaatcttgtgtgtagcagagatgcaatgtggcttctccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtgctttaacttgaatgtctcttgtgtttgccaaggtaatatgtaagtatgtaaataatttatttgtcagtggcactttaccattctcagatcttctttcttgggaacatctgatttattctcaagtgctatttttcactgaaactgttctctatttgagatattatcaaagtttcagaatcacagcaattctcagagatgagcccaaaagttttacaaatatttcaccatagttaaaaatttttaaagatctgtcctttcatttgttttcctaaatttacactataagtaacatactttttatatttgagattttgatttctcttcagtgtttattttacttaatttgaaccaagactcaacttttccacagaagaaatctaaaaggtttctctgctgctgtttctgatcaattgtttctcataaatcctactggcaaactcttctgtccctctaggccctcaaatactcttttcgggtcctcctggtgctccccaaagccattccaggtccttagaaatgtcttagtctagattaatttcctggttctcagtccagatacacaacctcatgggaagaaacaaaaactgccacttttatccattccaggtgcttagatgaactgccatagaaagcagctcagtccaaaacgctcaaatggtgctccaggatttacttttttgtattgttttgttttgttttttgcgacggagtctcgctctgtcgcccaggctggaatgcagtggcgtgaactcggctcactgcaagctccgcctcccgggttcacgccattctcctgcctcagcctcccgagtagctgggactacaggcgcccaccaccacgcccggctaatttttttttgtattttttagtagagacggggtttcaccatgttagccaggatggtctcgatctcctgacctcatgatccgcccgcctcggcctcccaaagtgctgggattacaggcgtaagccaccgcgcccggccaggatttactttcttaaatgcactcttttcattcccattcaaaggactccagtataagtgccacataaactcgttttctaacttttaaaactcttcctctaaatgcagcccaactcagtaaaaacgtacctaagatctcacagtctaatgtttccagcttttaaagcctttactcctacccttccctctgcctggaaagtgtctccattccctgctgtggacaaaatccctcaaggtcttttataatttcccccaaccccaaatcaacttggattttcttggagttctcacagcattcagtttatgtcctattcttacccttgtgttactgatattcacgaaattgctcagtcctttcaagagattgcttaaggacaaagacttcttactcaactctgcaatattggctacacatagctgacttaataaatagtcccttgactggtataagctgacgttacaaaaactggtaattccgaaaccactcatactggacttattaaataatccctcaactggtacagactgacattacaaaaacggattaattcagagatcactgaacacccaaaacactcagattcttataactatgattcagtaaatatgtgtggaatgcctatcttaccaggtgactatgttaggcgctgcatgagatataagatgaaaacaaggttcccattttccagggaagaatactggagtggaaaacgcagaggataccacaacaggagagctatttccgattagcggccgccactgctgagctatgtgaccctgagcaagtcacttcttaggtctccgtttctctgtcaaggagagatagaaaaagaacctatttcacaggttcaaacctacctcaagaaaaaatagttgtggggaatgcgtcacgagacctagaaaacggtacaaaaccctcggggggccgctgtttctgacctagcgagtggcccgacccggacaaaatgcctcttcctcgaggaggcggcgacgagcccagcaacagctcgagcacggccggccgggccgcgggaagcccgagaacgcggcgcgcgcagctgggaggcgacccttacccggcgaggctcccgggaccaaacgccgcccgacagccacgcagaacagacgtggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcacagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatggaatatatattagatgtaaagaattttctgcaataaaagaaactagacttgttaatccctgccttgcaatgtcagtaggataaagcagctataaaaattagtacttgcccaaggcctgaaagagaattagtgggaattaagatcaacttctcagttttgtttgtttactttttaattggcttttctttgttgttaagaatgagagacttaatttccatgggagttggagtgtgtgtgctgcaggcaggatcctgtggctcatttggcatggagacctggacatgtagtcagcaggagacggttccctaaataaaagatttgggcactggtg

SEQ ID NO: 737226 - DNA, 5438 bp, Homo sapiens
catgtaaatatgacctcagacaaaaaggaaccagaggcccaagggcaataataaggtggaatttgcaggtcagcccaggaattggcagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacatgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtgctttaacttgaatgtctcttgtgtttgccaaggtaatatgtaagtatgtaaataatttatttgtcagtggcactttaccattctcagatcttctttcttgggaacatctgatttattctcaagtgctatttttcactgaaactgttctctatttgagatattatcaaagtttcagaatcacagcaattctcagagatgagcccaaaagttttacaaatatttcaccatagttaaaaatttttaaagatctgtcctttcatttgttttcctaaatttacactataagtaacatactttttatatttgagattttgatttctcttcagtgtttattttacttaatttgaaccaagactcaacttttccacagaagaaatctaaaaggtttctctgctgctgtttctgatcaattgtttctcataaatcctactggcaaactcttctgtccctctaggccctcaaatactcttttcgggtcctcctggtgctccccaaagccattccaggtccttagaaatgtcttagtctagattaatttcctggttctcagtccagatacacaacctcatgggaagaaacaaaaactgccacttttatccattccaggtgcttagatgaactgccatagaaagcagctcagtccaaaacgctcaaatggtgctccaggatttacttttttgtattgttttgttttgttttttgcgacggagtctcgctctgtcgcccaggctggaatgcagtggcgtgaactcggctcactgcaagctccgcctcccgggttcacgccattctcctgcctcagcctcccgagtagctgggactacaggcgcccaccaccacgcccggctaatttttttttgtattttttagtagagacggggtttcaccatgttagccaggatggtctcgatctcctgacctcatgatccgcccgcctcggcctcccaaagtgctgggattacaggcgtaagccaccgcgcccggccaggatttactttcttaaatgcactcttttcattcccattcaaaggactccagtataagtgccacataaactcgttttctaacttttaaaactcttcctctaaatgcagcccaactcagtaaaaacgtacctaagatctcacagtctaatgtttccagcttttaaagcctttactcctacccttccctctgcctggaaagtgtctccattccctgctgtggacaaaatccctcaaggtcttttataatttcccccaaccccaaatcaacttggattttcttggagttctcacagcattcagtttatgtcctattcttacccttgtgttactgatattcacgaaattgctcagtcctttcaagagattgcttaaggacaaagacttcttactcaactctgcaatattggctacacatagctgacttaataaatagtcccttgactggtataagctgacgttacaaaaactggtaattccgaaaccactcatactggacttattaaataatccctcaactggtacagactgacattacaaaaacggattaattcagagatcactgaacacccaaaacactcagattcttataactatgattcagtaaatatgtgtggaatgcctatcttaccaggtgactatgttaggcgctgcatgagatataagatgaaaacaaggttcccattttccagggaagaatactggagtggaaaacgcagaggataccacaacaggagagctatttccgattagcggccgccactgctgagctatgtgaccctgagcaagtcacttcttaggtctccgtttctctgtcaaggagagatagaaaaagaacctatttcacaggttcaaacctacctcaagaaaaaatagttgtggggaatgcgtcacgagacctagaaaacggtacaaaaccctcggggggccgctgtttctgacctagcgagtggcccgacccggacaaaatgcctcttcctcgaggaggcggcgacgagcccagcaacagctcgagcacggccggccgggccgcgggaagcccgagaacgcggcgcgcgcagctgggaggcgacccttacccggcgaggctcccgggaccaaacgccgcccgacagccacgcagaacagacgtggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcacagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatggaatatatattagatgtaaagaattttctgcaataaaagaaactagacttgttaatccctgccttgcaatgtcagtaggataaagcagctataaaaattagtacttgcccaaggcctgaaagagaattagtgggaattaagatcaacttctcagttttgtttgtttactttttaattggcttttctttgttgttaagaatgagagacttaatttccatgggagttggagtgtgtgtgctgcaggcaggatcctgtggctcatttggcatggagacctggacatgtagtcagcaggagacggttccctaaataaaagatttgggcactggtg

SEQ ID NO: 737227 - DNA, 5489 bp, Homo sapiens
catgtaaatatgacctcagacaaaaaggaaccagaggcccaagggcaataataaggtggaatttgcaggtcagcccaggaattggcagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacatgtgaagtggaatctctgaaactcaggtgtggcatcaacaaagtcaagaagatacaacagcctcagtcaggaatgacaggaatacctgcatactttccctaactcaataccggaaaacggacaatatgaagagaggagggatggagcaagatgtgcccacaagacaggtgtgataagtttccataaaaactgatgcttcagaagaagggagcgtgaaagactcaaaggcaatgacagagtaatcttgtgtgtagcagagatgcaatgtggcttctccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtgctttaacttgaatgtctcttgtgtttgccaaggtaatatgtaagtatgtaaataatttatttgtcagtggcactttaccattctcagatcttctttcttgggaacatctgatttattctcaagtgctatttttcactgaaactgttctctatttgagatattatcaaagtttcagaatcacagcaattctcagagatgagcccaaaagttttacaaatatttcaccatagttaaaaatttttaaagatctgtcctttcatttgttttcctaaatttacactataagtaacatactttttatatttgagattttgatttctcttcagtgtttattttacttaatttgaaccaagactcaacttttccacagaagaaatctaaaaggtttctctgctgctgtttctgatcaattgtttctcataaatcctactggcaaactcttctgtccctctaggccctcaaatactcttttcgggtcctcctggtgctccccaaagccattccaggtccttagaaatgtcttagtctagattaatttcctggttctcagtccagatacacaacctcatgggaagaaacaaaaactgccacttttatccattccaggtgcttagatgaactgccatagaaagcagctcagtccaaaacgctcaaatggtgctccaggatttacttttttgtattgttttgttttgttttttgcgacggagtctcgctctgtcgcccaggctggaatgcagtggcgtgaactcggctcactgcaagctccgcctcccgggttcacgccattctcctgcctcagcctcccgagtagctgggactacaggcgcccaccaccacgcccggctaatttttttttgtattttttagtagagacggggtttcaccatgttagccaggatggtctcgatctcctgacctcatgatccgcccgcctcggcctcccaaagtgctgggattacaggcgtaagccaccgcgcccggccaggatttactttcttaaatgcactcttttcattcccattcaaaggactccagtataagtgccacataaactcgttttctaacttttaaaactcttcctctaaatgcagcccaactcagtaaaaacgtacctaagatctcacagtctaatgtttccagcttttaaagcctttactcctacccttccctctgcctggaaagtgtctccattccctgctgtggacaaaatccctcaaggtcttttataatttcccccaaccccaaatcaacttggattttcttggagttctcacagcattcagtttatgtcctattcttacccttgtgttactgatattcacgaaattgctcagtcctttcaagagattgcttaaggacaaagacttcttactcaactctgcaatattggctacacatagctgacttaataaatagtcccttgactggtataagctgacgttacaaaaactggtaattccgaaaccactcatactggacttattaaataatccctcaactggtacagactgacattacaaaaacggattaattcagagatcactgaacacccaaaacactcagattcttataactatgattcagtaaatatgtgtggaatgcctatcttaccaggtgactatgttaggcgctgcatgagatataagatgaaaacaaggttcccattttccagggaagaatactggagtggaaaacgcagaggataccacaacaggagagctatttccgattagcggccgccactgctgagctatgtgaccctgagcaagtcacttcttaggtctccgtttctctgtcaaggagagatagaaaaagaacctatttcacaggttcaaacctacctcaagaaaaaatagttgtggggaatgcgtcacgagacctagaaaacggtacaaaaccctcggggggccgctgtttctgacctagcgagtggcccgacccggacaaaatgcctcttcctcgaggaggcggcgacgagcccagcaacagctcgagcacggccggccgggccgcgggaagcccgagaacgcggcgcgcgcagctgggaggcgacccttacccggcgaggctcccgggaccaaacgccgcccgacagccacgcagaacagacgtggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcacagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatggaatatatattagatgtaaagaattttctgcaataaaagaaactagacttgttaatccctgccttgcaatgtcagtaggataaagcagctataaaaattagtacttgcccaaggcctgaaagagaattagtgggaattaagatcaacttctcagttttgtttgtttactttttaattggcttttctttgttgttaagaatgagagacttaatttccatgggagttggagtgtgtgtgctgcaggcaggatcctgtggctcatttggcatggagacctggacatgtagtcagcaggagacggttccctaaataaaagatttgggcactggtg

SEQ ID NO: 737228 - DNA, 7283 bp, Homo sapiens
tttaaataaatttaaagaaacacaaatgtattattttcaaactgtaaattttataaccattatataaatgggcactgatatacaaaataatgtcagttgctaaaacaagacaattcacagctggcctacatcatataatggcagaaatctttaaacacaaaatctaatgattagaaccagaagttgaaggcccactgaaggagtccttaatattatgaggcctaggtttcaaaaagctaccaattctagaatggattttactctggaactgtttcttgactatttcttgttgcatctctttcagtgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccacatttttcaagaatttctctataatccccatgttctaagccttgaaaatcatattcaggttcctttttgtaaagaagattttcccatgcatttgctatggttatttgttttacttcttcccaactttttgcccagttaaaaattgcactttttatattgtagattttaattttggaaactcctttatctcctttctcttgctcatcatcactttcttcaaatattacaagactctcttcaagttgcttccatctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatgattgactttaatttatgagttccgtctgcatttgcacataaaaaggcagacaacctttctttgtttattttcttccctggtaggcagatatctttcctacttgcctgagaattttctggcattgacttccaaaagaggtctgtttcatccccactgtatagctgagctagacacagtttctcctctttgattatcatggacagtttttgtcgaaatggctcaacattttcagaaactgaacttaggacttgttccccacatccttttcggttcccaattgcatgccgatttcgaaatctaaaaagccaaccagtgctagctttgaaatctgttcgcccaaaacaccgtgcaaatctctctgcagcagcctgaagctccacgcctcttaccggaacaccggctgagcgtttctgttggtaccacatgtagaccgcatcatctacatcaccatatttggctcccgttgtcctctttctcttctcagcccctactaatggcatgtcctgcttcagtacaaagtccagaattaacttcttattttttttaatgtcataaaatgttgacttactgattccaaattcatccattacacttttaagtgatcgtccagcttcaattctacttagaaccttcattttctcctccaaattcagtgttgtatatttccctctcttattcatactgaatttaactctgaaccaccaacaggagaaaacaaagggaaaagccttaatgaattggcaaaaaaaaaacccacattttttaaacaaaacttagctgaaagccccagaaggcatgggcattgtattggaggataatggactgaaggggctaaccatgactgaagagctagtctagaggtggaggtcttatgcactcagaaagctgccagttgcaaagtcctgtctggctcttgctcctgcaagccatgagtgatcatttttcagaatgccccctacctctcctctcttttgacagatacaacagcctcagtcaggaatgacaggaatacctgcatactttccctaactcaataccggaaaacggacaatatgaagagaggagggatggagcaagatgtgcccacaagacaggtgtgataagtttccataaaaactgatgcttcagaagaagggagcgtgaaagactcaaaggcaatgacagagtaatcttgtgtgtagcagagatgcaatgtggcttctccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtgctttaacttgaatgtctcttgtgtttgccaaggtaatatgtaagtatgtaaataatttatttgtcagtggcactttaccattctcagatcttctttcttgggaacatctgatttattctcaagtgctatttttcactgaaactgttctctatttgagatattatcaaagtttcagaatcacagcaattctcagagatgagcccaaaagttttacaaatatttcaccatagttaaaaatttttaaagatctgtcctttcatttgttttcctaaatttacactataagtaacatactttttatatttgagattttgatttctcttcagtgtttattttacttaatttgaaccaagactcaacttttccacagaagaaatctaaaaggtttctctgctgctgtttctgatcaattgtttctcataaatcctactggcaaactcttctgtccctctaggccctcaaatactcttttcgggtcctcctggtgctccccaaagccattccaggtccttagaaatgtcttagtctagattaatttcctggttctcagtccagatacacaacctcatgggaagaaacaaaaactgccacttttatccattccaggtgcttagatgaactgccatagaaagcagctcagtccaaaacgctcaaatggtgctccaggatttacttttttgtattgttttgttttgttttttgcgacggagtctcgctctgtcgcccaggctggaatgcagtggcgtgaactcggctcactgcaagctccgcctcccgggttcacgccattctcctgcctcagcctcccgagtagctgggactacaggcgcccaccaccacgcccggctaatttttttttgtattttttagtagagacggggtttcaccatgttagccaggatggtctcgatctcctgacctcatgatccgcccgcctcggcctcccaaagtgctgggattacaggcgtaagccaccgcgcccggccaggatttactttcttaaatgcactcttttcattcccattcaaaggactccagtataagtgccacataaactcgttttctaacttttaaaactcttcctctaaatgcagcccaactcagtaaaaacgtacctaagatctcacagtctaatgtttccagcttttaaagcctttactcctacccttccctctgcctggaaagtgtctccattccctgctgtggacaaaatccctcaaggtcttttataatttcccccaaccccaaatcaacttggattttcttggagttctcacagcattcagtttatgtcctattcttacccttgtgttactgatattcacgaaattgctcagtcctttcaagagattgcttaaggacaaagacttcttactcaactctgcaatattggctacacatagctgacttaataaatagtcccttgactggtataagctgacgttacaaaaactggtaattccgaaaccactcatactggacttattaaataatccctcaactggtacagactgacattacaaaaacggattaattcagagatcactgaacacccaaaacactcagattcttataactatgattcagtaaatatgtgtggaatgcctatcttaccaggtgactatgttaggcgctgcatgagatataagatgaaaacaaggttcccattttccagggaagaatactggagtggaaaacgcagaggataccacaacaggagagctatttccgattagcggccgccactgctgagctatgtgaccctgagcaagtcacttcttaggtctccgtttctctgtcaaggagagatagaaaaagaacctatttcacaggttcaaacctacctcaagaaaaaatagttgtggggaatgcgtcacgagacctagaaaacggtacaaaaccctcggggggccgctgtttctgacctagcgagtggcccgacccggacaaaatgcctcttcctcgaggaggcggcgacgagcccagcaacagctcgagcacggccggccgggccgcgggaagcccgagaacgcggcgcgcgcagctgggaggcgacccttacccggcgaggctcccgggaccaaacgccgcccgacagccacgcagaacagacgtggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcacagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatggaatatatattagatgtaaagaattttctgcaataaaagaaactagacttgttaatccctgccttgcaatgtcagtaggataaagcagctataaaaattagtacttgcccaaggcctgaaagagaattagtgggaattaagatcaacttctcagttttgtttgtttactttttaattggcttttctttgttgttaagaatgagagacttaatttccatgggagttggagtgtgtgtgctgcaggcaggatcctgtggctcatttggcatggagacctggacatgtagtcagcaggagacggttccctaaataaaagatttgggcactggtg

SEQ ID NO: 737229 - DNA, 2571 bp, Homo sapiens
tttaaataaatttaaagaaacacaaatgtattattttcaaactgtaaattttataaccattatataaatgggcactgatatacaaaataatgtcagttgctaaaacaagacaattcacagctggcctacatcatataatggcagaaatctttaaacacaaaatctaatgattagaaccagaagttgaaggcccactgaaggagtccttaatattatgaggcctaggtttcaaaaagctaccaattctagaatggattttactctggaactgtttcttgactatttcttgttgcatctctttcagtgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccacatttttcaagaatttctctataatccccatgttctaagccttgaaaatcatattcaggttcctttttgtaaagaagattttcccatgcatttgctatggttatttgttttacttcttcccaactttttgcccagttaaaaattgcactttttatattgtagattttaattttggaaactcctttatctcctttctcttgctcatcatcactttcttcaaatattacaagactctcttcaagttgcttccatctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatgattgactttaatttatgagttccgtctgcatttgcacataaaaaggcagacaacctttctttgtttattttcttccctggtaggcagatatctttcctacttgcctgagaattttctggcattgacttccaaaagaggtctgtttcatccccactgtatagctgagctagacacagtttctcctctttgattatcatggacagtttttgtcgaaatggctcaacattttcagaaactgaacttaggacttgttccccacatccttttcggttcccaattgcatgccgatttcgaaatctaaaaagccaaccagtgctagctttgaaatctgttcgcccaaaacaccgtgcaaatctctctgcagcagcctgaagctccacgcctcttaccggaacaccggctgagcgtttctgttggtaccacatgtagaccgcatcatctacatcaccatatttggctcccgttgtcctctttctcttctcagcccctactaatggcatgtcctgcttcagtacaaagtccagaattaacttcttattttttttaatgtcataaaatgttgacttactgattccaaattcatccattacacttttaagtgatcgtccagcttcaattctacttagaaccttcattttctcctccaaattcagtgttgtatatttccctctcttattcatactgaatttaactctggacagggctgcggtaggccagcggtgggctggcggttgcgctcctcagatcggcggcctttcgggcggtggcttgcgtttgagcctcagaaagcgaggagcggcctccacggaagccaagctggccgaggtaaccgagaagcggcttcccctatggcttcgaccctggagccgctggagcggcggcggccgcagggaggcagccattttccgtaggcggtggccgcggcgcttccgggccgcgcggctggagcctgaggcggggccaccgtcgggcacgagaaaccattctctccccgcttttcgcagctgtatcccagaggcgcggctgaagctcgctgggacactgcccgcttgcccagtgcccacgggcacgcctgtcgcagacacaggctgtggcgaatccgagtgctggcgggcagcagtgcctgcagctgcgcccgcagactctttcccgcctccgccggcatttccgtgtccggccgatgtcatgcggtcggttgagcctcagggctagcagcttctactgatgcaaaaacataggaagtgtctctttgcttctggaaccggggtgggcagcaaggagctggccacttctttgaataccggtggcatcctgggcagaatttcggtgccgtttctgctggctcacttcaggaaaagtgaggctcacggctctcctcagccccccttagaagtctaaatgacctttggagaaatacaaagtcagcagaaagtttcac

SEQ ID NO: 737230 - DNA, 2864 bp, Homo sapiens
  misc_feature (820)..(820): n is a, c, g, or t
ccccgcccccccgcgcccgcggccccaagcggttcccgagcccaggcccgcgccgagcccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggnctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgtgccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagctgtttgtgctgcacagcaagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacatgttagacattaccgtaaaattaaaacgcacaaatttgcagaaaaaaaaaaaaaaaaaaaaaaaaaaaaaaaaaaaaaaaaaaaaaaaaaaaaaaagggggggcccctaaaattttccccgggggggccaaattcggacccgaagtttttttagtcataggggggcccccatattaggaggaggctgcttattatataaatacagccagtagtagcaccggggccggctggttaataacaactgttgtacgagggggaaacaacttggtaatacttgggagccacttttggggagaagagaaccccctataacttcgggggggggtggcaacaattaggggggggacaatatctacctctaagggaagaatattgaagcagcctccagaaggagaacaattataaaaattcttcaacgggtgtgtatttcagcggtgttcaaacaaaagggcgcatataatgatcgtgggcgggacttggaaaaaagtttgggcctcagcgggatttttaagtattgagaaagattttttatatcgagggattctattttaaaaatgag

SEQ ID NO: 737231 - DNA, 362 bp, Homo sapiens
tcttagcatggagatgagtgttactgggcagctggcctgggagcatcactgtgccaggcctgggctgagcccggtacataccttccccaacagctccgtaaagtgggggcggttgggggttcccatttgacagacggaggtgtctgagctgcggggccaggagggaaaggtgggcccttctcccttctccctgctgctttctgtcctctgtcccctgagcctgggagctgggtccacctgtttatccacccactccccacagctgaaggaggttgtgctgaagagcagcaaggtcgtgcgggctgacgtctgcgtggtgggcattggtgagttggtgtgtgggcaggcaggcacaaagcagc

SEQ ID NO: 737232 - DNA, 551 bp, Homo sapiens
cccaggcctggcacagtggatgctcccagtgcccgctgcccagtaacactcatctccatgccctacgagagttgacatagacgagactcgaactggctcctgctccagctgaggtgccaatttgggtaggggccaagatgggaggtggtagcacctgcaggggctgaggaggtatggcatgctgtccctccacttaagggcctcatggagcacttcttggagaaggtgatatctgaggtcttgcgggaggcaccgggtctgtgggagaccgggtagtggggaccagggtgcatgaaggcctcaggtagacagcccctggaggatcagtctggggctggcacatcaagcgcatggtgtagggtgtggagagtgactacgcagaagggagggacaggggagtggacacaggcttccgtcctgtcaggtgcagtgcccgccacaggcttcctgaggcaaagcggcatcggtttggattcccgaggcttcatccctgtcaacaaggtggggtggatggcactgggtggggaggacccggtgctgggctgggagtg

SEQ ID NO: 737233 - DNA, 1237 bp, Homo sapiens
gcaaaatcccagaacaagagcccagccctgagccccgctgaggagtgctggagcttccttaggaaagcccgaagcttgtgcacggtcaagccgcgatgtgcaaagcagggagggctgggtgctcaggccattcttgttgccctggggtaggtccttccctgggccccagatggacagcagtgcatcagggttttcaaaaaggggctgctgcctcgcagtcctcaggcttggccatcctctccttgcagaggcgacgaggtgatcgccgtggccagcatgaactacgatcccattgtgtccaaggtcgctgaggtgctggcctcaggccgtgccatccggaagcgggaggtggagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacatgttagacattaccgtaaaattaaaacgcacaaatttgcagaaaaaaaaaaaaaaaaaaaaaaaaaaaaaaaaaaaaaaaaaaaaaaaaaaaaaaagggggggcccctaaaattttccccgggggggccaaattcggacccgaagtttttttagtcataggggggcccccatattaggaggaggctgcttattatataaatacagccagtagtagcaccggggccggctggttaataacaactgttgtacgagggggaaacaacttggtaatacttgggagccacttttggggagaagagaaccccctataacttcgggggggggtggcaacaattaggggggggacaatatctacctctaagggaagaatattgaagcagcctccagaaggagaacaattataaaaattcttcaacgggtgtgtatttcagcggtgttcaaacaaaagggcgcatataatgatcgtgggcgggacttggaaaaaagtttgggcctcagcgggatttttaagtattgagaaagattttttatatcgagggattctattttaaaaatgag

SEQ ID NO: 737234 - DNA, 989 bp, Homo sapiens
cacagaacagaccccctgctgtcctcaagggccagctgttcagggtgcccagagtggagagcctgttttcttctgtcttgaccactcctcccctcactcctgcaggactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacatgttagacattaccgtaaaattaaaacgcacaaatttgcagaaaaaaaaaaaaaaaaaaaaaaaaaaaaaaaaaaaaaaaaaaaaaaaaaaaaaaagggggggcccctaaaattttccccgggggggccaaattcggacccgaagtttttttagtcataggggggcccccatattaggaggaggctgcttattatataaatacagccagtagtagcaccggggccggctggttaataacaactgttgtacgagggggaaacaacttggtaatacttgggagccacttttggggagaagagaaccccctataacttcgggggggggtggcaacaattaggggggggacaatatctacctctaagggaagaatattgaagcagcctccagaaggagaacaattataaaaattcttcaacgggtgtgtatttcagcggtgttcaaacaaaagggcgcatataatgatcgtgggcgggacttggaaaaaagtttgggcctcagcgggatttttaagtattgagaaagattttttatatcgagggattctattttaaaaatgag

SEQ ID NO: 737235 - DNA, 2843 bp, Homo sapiens
  misc_feature (820)..(820): n is a, c, g, or t
ccccgcccccccgcgcccgcggccccaagcggttcccgagcccaggcccgcgccgagcccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggnctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgtgccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacatgttagacattaccgtaaaattaaaacgcacaaatttgcagaaaaaaaaaaaaaaaaaaaaaaaaaaaaaaaaaaaaaaaaaaaaaaaaaaaaaaagggggggcccctaaaattttccccgggggggccaaattcggacccgaagtttttttagtcataggggggcccccatattaggaggaggctgcttattatataaatacagccagtagtagcaccggggccggctggttaataacaactgttgtacgagggggaaacaacttggtaatacttgggagccacttttggggagaagagaaccccctataacttcgggggggggtggcaacaattaggggggggacaatatctacctctaagggaagaatattgaagcagcctccagaaggagaacaattataaaaattcttcaacgggtgtgtatttcagcggtgttcaaacaaaagggcgcatataatgatcgtgggcgggacttggaaaaaagtttgggcctcagcgggatttttaagtattgagaaagattttttatatcgagggattctattttaaaaatgag

SEQ ID NO: 737236 - DNA, 2000 bp, Homo sapiens
agggagagagaaagagagagagaaagaaaggaagacagaggaaagaaaggaagacagagagaggaaggcagagagagagagggagaaagaaagacaggaaggcagagagagagagagagagagaaaggaagacagagagagagagagaggaagagagagagagagaggaagagagagagagagctcatgagccaggatccctggggaatttgaagtcagtgtgaccagggttctgtggctctggggtcagagctgggacacaggacccagcaggagggccaccaccccttccttttggaaacagctctggttccaagcagcaatcaggtaggaggatcggggctttggctgatgatgcacacacaagatgctgatggtgtacggtgagatattgtgaacgcaacaactggagctgtagttggcgtgtgtgagtgtgtacctgcggttctgtttagtggcgagacaaggtatgtttcagtactgctttcacggcaactgtgtaatgcatatgctctttctacactagcggtttgctcagttttgtctgtccggttaagttggagaaagaaccaagttgtgttgttctctggagggggtgctgctgcctctccttgagtagttctgtgacccccaatccagctgttttgtagagaatccttctagcttctggtatgcctgctctccagcagctggaaacagatcttcctgcctgaccaaagctccttgtttcttgcgtggcatgtttgttcttcccgatccggtggctgtcgtagccgagggcctgcctgccaccttcctttatcatttgccctgttggggttcagggtgcatccttagcccaggacctgctcttccagcatcatgggttttttcctaaagatctcaacggctcccttgggctccataaaatatttcttttttaaaaaagcagactcctttcatgcattgggatgaacggccctcttgtctgggtgctgggctacagcaaacaaatgtgtttgaatcccagtattccagagattcctggcggtgggctgtctagaagaggcgaggctggatctcacggtttttaaactgtatttttacccctttgggacccatacctgtgccctggagtctttcatgaggcacgtgggtcctctgcatcctcactctcccccctagcccaggtgcagccccgggaggggtgccctgaccccgccttaaacaaccaactttcccaccgaatcccatcggcgggcgggggggggggtttgggtgccaagtgccctggaaacctattgtcttttggctcagccaaaagaaacattccctccttcctttccttccgggcttgggggaaccttcgtaaaaatcatagttagggttaagtccaagcagtgaggcctgacctgggctctgctctccttgttgagacactaacaggcagttgggaggaaaatctgcatttgactccaccctctttggggcaaaggagaaacaggtgacccgagggggggcaggccagaggagggcgactcgtgcacagggacccccacccttggaccccgctgtccttttctagttgtttacttggtggtggcagccagtctgaccttgtctgtggtctgactgttcctaagtgtgtaactttcagtattatctgtgacagatggttctgtggtgaaaaaggtttattatattccttatggctgccttgtacaaaatccgttagaaacgctaatgtaagatatcagatttctaacaagacaaaaacagcattatggagttaaaagatttttacaactgggtcttgattttgatgtgagctggtttttagctctcaaatgttgtcacttaaataaaaaccttctttgcctttacaatgtgttttggtctgaactaagttgagaaacctttccctttctacatgttctccctggggtgggattgggggcagactggctcggagcagaggtggatgagggccagaccccaaaccacaaattacaaatctatag

SEQ ID NO: 737237 - DNA, 1901 bp, Homo sapiens
agggagagagaaagagagagagaaagaaaggaagacagaggaaagaaaggaagacagagagaggaaggcagagagagagagggagaaagaaagacaggaaggcagagagagagagagagagagaaaggaagacagagagagagagagaggaagagagagagagagaggaagagagagagagagctcatgagccaggatccctggggaatttgaagtcagtgtgaccagggttctgtggctctggggtcagagctgggacacaggacccagcaggagggccaccaccccttccttttggaaacagctctggttccaagcagcaatcaggtaggaggatcggggctttggctgatgatgcacacacaagatgctgatggtgtacggtgagatattgtgaacgcaacaactggagctgtagttggcgtgtgtgagtgtgtacctgcggttctgtttagtggcgagacaaggtatgtttcagtactgctttcacggcaactgtgtaatgcatatgctctttctacactagcggtttgctcagttttgtctgtccggttaagttggagaaagaaccaagttgtgttgttctctggagggggtgctgctgcctctccttgagtagttctgtgacccccaatccagctgttttgtagagaatccttctagcttctggtatgcctgctctccagcagctggaaacagatcttcctgcctgaccaaagctccttgtttcttgcgtggcatgtttgttcttcccgatccggtggctgtcgtagccgagggcctgcctgccaccttcctttatcatttgccctgttggggttcagggtgcatccttagcccaggacctgctcttccagcatcatgggttttttcctaaagatctcaacggctcccttgggctccataaaatatttcttttttaaaaaagcagactcctttcatgcattgggatgaacggccctcttgtctgggtgctgggctacagcaaacaaatgtgtttgaatcccagtattccagagattcctggcggtgggctgtctagaagaggcgaggctggatctcacggtttttaaactgtatttttacccctttgggacccatacctgtgccctggagtctttcatgaggcacgtgggtcctctgcatcctcactctcccccctagcccaggtgcagccccgggaggggtgccctgaccccgccttaaacaaccaactttcccaccgaatcccatcggcgggcgggggggggggtttgggtgccaagtgccctggaaacctattgtcttttggctcagccaaaagaaacattccctccttcctttccttccgggcttgggggaaccttcgtaaaaatcatagttagggttaagtccaagcagtgaggcctgacctgggctctgctctccttgttgagacactaacaggcagttgggaggaaaatctgcatttgactccaccctctttggggcaaaggagaaacaggtgacccgagggggggcaggccagaggagggcgactcgtgcacagggacccccacccttggaccccgctgtccttttctagttgtttacttggtggtggcagccagtctgaccttgtctgtggtctgactgttcctaagtgtgtaactttcagtattatctgtgacagatggttctgtggtgaaaaaggtttattatattccttatggctgccttgtacaaaatccgttagaaacgctaatgtaagatatcagatttctaacaagacaaaaacagcattatggagttaaaagatttttacaactgggtcttgattttgatgtgagctggtttttagctctcaaatgttgtcacttaaataaaaaccttctttgcctttaaaaaaaaaagtcgacgcggccgcgaatttagtagtagta

SEQ ID NO: 737238 - DNA, 1348 bp, Homo sapiens
  misc_feature (10)..(10): n is a, c, g, or t
  misc_feature (20)..(20): n is a, c, g, or t
tcagttgtcncccgggttanggatagtcgaccagccccgggggtgctgctgcctctccttgagtagttctgtgacccccaatccagctgttttgtagagaatccttctagcttctggtatgcctgctctccagcagctggaaacagatcttcctgcctgaccaaagctccttgtttcttgcgtggcatgtttgttcttcccgatccggtggctgtcgtagccgagggcctgcctgccaccttcctttatcatttgccctgttggggttcagggtgcatccttagcccaggacctgctcttccagcatcatgggttttttcctaaagatctcaacggctcccttgggctccataaaatatttcttttttaaaaaagcagactcctttcatgcattgggatgaacggccctcttgtctgggtgctgggctacagcaaacaaatgtgtttgaatcccagtattccagagattcctggcggtgggctgtctagaagaggcgaggctggatctcacggtttttaaactgtatttttacccctttgggacccatacctgtgccctggagtctttcatgaggcacgtgggtcctctgcatcctcactctcccccctagcccaggtgcagccccgggaggggtgccctgaccccgccttaaacaaccaactttcccaccgaatcccatcggcgggcgggggggggggtttgggtgccaagtgccctggaaacctattgtcttttggctcagccaaaagaaacattccctccttcctttccttccgggcttgggggaaccttcgtaaaaatcatagttagggttaagtccaagcagtgaggcctgacctgggctctgctctccttgttgagacactaacaggcagttgggaggaaaatctgcatttgactccaccctctttggggcaaaggagaaacaggtgacccgagggggggcaggccagaggagggcgactcgtgcacagggacccccacccttggaccccgctgtccttttctagttgtttacttggtggtggcagccagtctgaccttgtctgtggtctgactgttcctaagtgtgtaactttcagtattatctgtgacagatggttctgtggtgaaaaaggtttattatattccttatggctgccttgtacaaaatccgttagaaacgctaatgtaagatatcagatttctaacaagacaaaaacagcattatggagttaaaagatttttacaactgggtcttgattttgatgtgagctggtttttagctctcaaatgttgtcacttaaataaaaaccttctttgcctttaaaaaaaaaagtcgacgcggccgcgaatttagtagtagta

SEQ ID NO: 737239 - DNA, 610 bp, Homo sapiens
gtgaggacagggctgctttgctctatcctccctgcaacttcagtgctgggcacaggactggctcttaatggatactgaatgaaccctgttatggactgaatgttcgcattctcccccacccccaaatgtatttgctgaagccctaatctccaatgtgatggtatcaggaggtggagccctcgaggggtaattagatttaggtgaggttgcgagggtggggccctcatgagtgcttttataagtagagaaagaagtaccagcgcttcctccctcatgcgaggatacggcaagaatgcatgtccataaggaagaaggcatgcaccagacatcaaatctgctggcgccttgatcttggtcttccagcctctagacctgtgagaaatgaatatctgttgttgaagcctcccagcctatgatggatttgttacagctggccaagctgacttagacaaatgagtgtgcctgatccatcccattgaatgtgacagaaccccaggaggcagatggtattcttgtcttgctaagtagggctgagtcactcaccaggcagcccagccaggcaagaggcaggctgactttctagcccaagcctccttctctagaacccaag

SEQ ID NO: 737240 - DNA, 1693 bp, Homo sapiens
  misc_feature (36)..(36): n is a, c, g, or t
aaattcgcggccgcgtcgactaacggctgcgagaanacgacagagagtcgagaaattcattttttggacaacattgttttgaaggcactactggggctctgggatcaggcagccagattgaaacctggctcctccttttcctaagttatttaacctccctgtgcctcactttttgtcaaccagataagataagaaatgagagcaggtctgttacctcacaaggtggctgtgagtgttgaagacgtttgttgggggtttgggtgaagcatgcaaactctggttggtatgtggcagccactcagcctgtatttatgatgagggaggcattctaggcaccccttccaggatgttgggttgttggctgggttttactttaaaaagctcagggcctagaacattctagaatccaagtacttgctcacatatataattatttctttaggataatctttgatatagacttacgagtcaaagggtatgtaaaatgtcagcccttttacctgtattgccaaattgccttcaaaagtttctgctgttttgccctcctacccatagtgataaccttaaattggagtcaacacaaatttgagtgtgactgtgttagacagaagggatatattaacaggtaaaactggccatggcccctgcccttgtggagtatatgctctgttggttcatttcctctgcattctaattttctagacttgggatcttattgtggagttaaacaaagcacccttaaagtagcaagcgagcaaaataaaagcaaggaaaatcagttggaacataacttatgtattttttaggattaagagtaatttaactgagtcaattcaatatgtttttaaaggtgtgattcttaaattctttatgattgtttagatttctatatcttggtaacatgaatacacacttaatgaaagatttcagtaatttttgatttgggaattaatcatagtgggaaaaactgtttaggaaaacatgtcagtggaaattaactcgccacagtatgtagtgttagggaatagcttctgttcggcatttgatttgagtgctgtattctgacatttttcaggaacaaatacatgtgattcatcttctataaatatttgcagtttcttcaagttgaaatgagaaaagctcgtaaattgagcaccaggtctaataaatcattcacttacccaagaacagaaagacaggaaaagctagcatgttaatctaatgaaaaaatcgaatgttaaaaaaccaagaaagtagaagatatttgacattaactttataatcattgataataatcctaataatccataacattattccttaaaacctgaaagaatggattccctgctccccaatgtgtttttaatatcaacttaaactaaaataatttttttacctatttttggaagcttggaaattgagatgtagttgtctaatgttaacctaattaagagagcttggtgtgatttctcatatacagcatctaaatatttaagttttaatgtcttctaaaatattattacattcttcatactatagttttttaacatcctttagaaaacttgtatcagcttcactttcaaaccatgctggcatcgaactcaggtgtagtggtatcagaatgttatgaaataattttttattttcattataaactccatttttacaataaacacttctcaaccaaaaaaaa

SEQ ID NO: 737241 - DNA, 2068 bp, Homo sapiens
catctcctgacctcaagtgattcacctgcttctgtctcccaaagtgctgggaatacaggcatgagccaccactcctggacaggccacagaaattttaaagaaaagaatcatgccaccacaagtaaacttcattttgtttatattatttaggacttcacatttgtcttccgaaaccatgaagtataattctgctaacagcaagtgttgtgaatgaggaattaggaattaggagaatggtagtacattgggaaaaacatattttagtaatttttatattttaaagataatcacagattttgctgtttgtgcatcaccaaaatcagtgagatctgccagctggtgggggtgtgcctatgagaatttttgattatgatcccctaggagggttatcaaaaaaggagatgggtgaaagatcaggagagtcgagaaattcattttttggacaacattgttttgaaggcactactggggctctgggatcaggcagccagattgaaacctggctcctccttttcctaagttatttaacctccctgtgcctcactttttgtcaaccagataagataagaaatgagagcaggtctgttacctcacaaggtggctgtgagtgttgaagacgtttgttgggggtttgggtgaagcatgcaaactctggttggtatgtggcagccactcagcctgtatttatgatgagggaggcattctaggcaccccttccaggatgttgggttgttggctgggttttactttaaaaagctcagggcctagaacattctagaatccaagtacttgctcacatatataattatttctttaggataatctttgatatagacttacgagtcaaagggtatgtaaaatgtcagcccttttacctgtattgccaaattgccttcaaaagtttctgctgttttgccctcctacccatagtgataaccttaaattggagtcaacacaaatttgagtgtgactgtgttagacagaagggatatattaacaggtaaaactggccatggcccctgcccttgtggagtatatgctctgttggttcatttcctctgcattctaattttctagacttgggatcttattgtggagttaaacaaagcacccttaaagtagcaagcgagcaaaataaaagcaaggaaaatcagttggaacataacttatgtattttttaggattaagagtaatttaactgagtcaattcaatatgtttttaaaggtgtgattcttaaattctttatgattgtttagatttctatatcttggtaacatgaatacacacttaatgaaagatttcagtaatttttgatttgggaattaatcatagtgggaaaaactgtttaggaaaacatgtcagtggaaattaactcgccacagtatgtagtgttagggaatagcttctgttcggcatttgatttgagtgctgtattctgacatttttcaggaacaaatacatgtgattcatcttctataaatatttgcagtttcttcaagttgaaatgagaaaagctcgtaaattgagcaccaggtctaataaatcattcacttacccaagaacagaaagacaggaaaagctagcatgttaatctaatgaaaaaatcgaatgttaaaaaaccaagaaagtagaagatatttgacattaactttataatcattgataataatcctaataatccataacattattccttaaaacctgaaagaatggattccctgctccccaatgtgtttttaatatcaacttaaactaaaataatttttttacctatttttggaagcttggaaattgagatgtagttgtctaatgttaacctaattaagagagcttggtgtgatttctcatatacagcatctaaatatttaagttttaatgtcttctaaaatattattacattcttcatactatagttttttaacatcctttagaaaacttgtatcagcttcactttcaaaccatgctggcatcgaactcaggtgtagtggtatcagaatgttatgaaataattttttattttcattataaactccatttttacaataaacacttctcaaccaaaaaaaa

SEQ ID NO: 737242 - DNA, 529 bp, Homo sapiens
actcctgtctagaattttaatttttaaccactgctgatggccagaaaagaacatttggattttacaaccagtctttgatggagaaagaaaaaaagtcagtgaacacccattttgtgcctgacattcaagtatgtttgttccctgtatttctccatttagtcctctcagaatctctggaggtggactggggcagattattagtctaccagaagtctcacctataccaaaccacacacctttcagttgaggggcgctgaggtccctgctgttgctgtgccatctgacctgtcccctctctctgacagagagccagctgctccccgggaacaacttcaccaatgagtgcaacataccaggcaacttcatgtgcagcaatggacggtgcatcccgggcgcctggcagtgtgacgggctgcctgactgcttcgacaagagtgatgagaaggagtgccgtgagtggcctggccctttgctggggtggggtggcagccatcctggggcagaggggagcaggtcctgagcaggctta

SEQ ID NO: 737243 - DNA, 1636 bp, Homo sapiens
gccgggcagcgggagcggcggccgcgccatgtggctgctggggccgctgtgcctgctgctgagcagcgccgcggagagccagctgctccccgggaacaacttcaccaatgagtgcaacataccaggcaacttcatgtgcagcaatggacggtgcatcccgggcgcctggcagtgtgacgggctgcctgactgcttcgacaagagtgatgagaaggagtgccccaaggctaagtcgaaatgtggcccaaccttcttcccctgtgccagcggcatccattgcatcattggtcgcttccggtgcaatgggtttgaggactgtcccgatggcagcgatgaagagaactgcacagcaaaccctctgctttgctccaccgcccgctaccactgcaagaacggcctctgtattgacaagagcttcatctgcgatggacagaataactgtcaagacaacagtgatgaggaaagctgtgaaagttctcaagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctggtggtcctggaccacccccaccactgcaacgtcacctacaacgtcaataatggcatccagtatgtggccagccaggcggagcagaatgcgtcggaagtaggctccccaccctcctactccgaggccttgctggaccagaggcctgcgtggtatgaccttcctccaccgccctactcttctgacacggaatctctgaaccaagccgacctgcccccctaccgctcccggtccgggagtgccaacagtgccagctcccaggcagccagcagcctcctgagcgtggaagacaccagccacagcccggggcagcctggcccccaggagggcactgctgagcccagggactctgagcccagccagggcactgaagaagtataagtcccagttattccaaagtccatatgggttaatctgctctgacttgttgccattctaacaatttgtgctcatgggaagctctttaagcacctgtaagggtgtctcaagttacagtttgggatattaactatctctgcattcccctcctcccccagacttcagagatgtttttctggcgtctcagttgacatgatctgttgtgcgtcttttctgtcaggtcactcttcccttgggacccgagatcacaccctcatttttcacattattctgtttctgttggagagacagcatataaaacagtattgaaataggctgggagagagcaatgtttctgtgctatattggatgctcagaagtgcaggagacgctggacccaattctctctgctgggtagttacctatatagcatttggggatttgggttagatgatctaaccaggaggacatcactggatggtcacccccccaaaaaaattccatttgagcatcaaaacctgctttgcacaatcctatttgatgcccccagttcagcagagtcagtggccaaagaaaactttggacgtgagtaac

SEQ ID NO: 737244 - DNA, 1489 bp, Homo sapiens
gccgggcagcgggagcggcggccgcgccatgtggctgctggggccgctgtgcctgctgctgagcagcgccgcggccaaggctaagtcgaaatgtggcccaaccttcttcccctgtgccagcggcatccattgcatcattggtcgcttccggtgcaatgggtttgaggactgtcccgatggcagcgatgaagagaactgcacagcaaaccctctgctttgctccaccgcccgctaccactgcaagaacggcctctgtattgacaagagcttcatctgcgatggacagaataactgtcaagacaacagtgatgaggaaagctgtgaaagttctcaagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctggtggtcctggaccacccccaccactgcaacgtcacctacaacgtcaataatggcatccagtatgtggccagccaggcggagcagaatgcgtcggaagtaggctccccaccctcctactccgaggccttgctggaccagaggcctgcgtggtatgaccttcctccaccgccctactcttctgacacggaatctctgaaccaagccgacctgcccccctaccgctcccggtccgggagtgccaacagtgccagctcccaggcagccagcagcctcctgagcgtggaagacaccagccacagcccggggcagcctggcccccaggagggcactgctgagcccagggactctgagcccagccagggcactgaagaagtataagtcccagttattccaaagtccatatgggttaatctgctctgacttgttgccattctaacaatttgtgctcatgggaagctctttaagcacctgtaagggtgtctcaagttacagtttgggatattaactatctctgcattcccctcctcccccagacttcagagatgtttttctggcgtctcagttgacatgatctgttgtgcgtcttttctgtcaggtcactcttcccttgggacccgagatcacaccctcatttttcacattattctgtttctgttggagagacagcatataaaacagtattgaaataggctgggagagagcaatgtttctgtgctatattggatgctcagaagtgcaggagacgctggacccaattctctctgctgggtagttacctatatagcatttggggatttgggttagatgatctaaccaggaggacatcactggatggtcacccccccaaaaaaattccatttgagcatcaaaacctgctttgcacaatcctatttgatgcccccagttcagcagagtcagtggccaaagaaaactttggacgtgagtaac

SEQ ID NO: 737245 - DNA, 527 bp, Homo sapiens; identical to SEQ ID NO: 437580

SEQ ID NO: 737246 - DNA, 1104 bp, Homo sapiens
agcggccgctcgcgatctagaactagtggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737247 - DNA, 1617 bp, Homo sapiens
tggggtggcagcctgggtcggccagagagttcaggccaccccggccggacgcctgccacttgctgtcactgtgccgctgtcatggcacgctccgggagtgccacgccacgatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737248 - DNA, 1191 bp, Homo sapiens
gcgggggcggccgggcggcgggggcggggaaggggcgggcgcggaggcggtgccgcagcccgagccggagcccgagccggatcccgaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaagctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737249 - DNA, 613 bp, Homo sapiens; identical to SEQ ID NO: 437587

SEQ ID NO: 737250 - DNA, 2126 bp, Homo sapiens
gcgggggcggccgggcggcgggggcggggaaggggcgggcgcggaggcggtgccgcagcccgagccggagcccgagccggatcccgaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737251 - DNA, 2093 bp, Homo sapiens
gcgggggcggccgggcggcgggggcggggaaggggcgggcgcggaggcggtgccgcagcccgagccggagcccgagccggatcccgaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737252 - DNA, 997 bp, Homo sapiens
gcgggggcggccgggcggcgggggcggggaaggggcgggcgcggaggcggtgccgcagcccgagccggagcccgagccggatcccgaggcgacgggagccgaacaggagccgccgctgaagccaccgccgggtgcccagcgccgccgccgcccccgaagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737253 - DNA, 956 bp, Homo sapiens; identical to SEQ ID NO: 437586

SEQ ID NO: 737254 - DNA, 2068 bp, Homo sapiens
gcgggggcggccgggcggcgggggcggggaaggggcgggcgcggaggcggtgccgcagcccgagccggagcccgagccggatcccgaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggagggctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737255 - DNA, 1801 bp, Homo sapiens
cgcacgcctgggccagcccagagtggtgccactgcccatgtgctgcccggaatgtgggccactgacccgctcctatcgcccattcgccccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737256 - DNA, 1918 bp, Homo sapiens
cagcggtgccaggccctggaggtggtggcagaccctgagccctctgccccctgcccctagcccatgtctccacccccatctggagggccttgggggctaagagcagccctggcctggcctggcctgtggtccctcagggacacacagggaggtaggaggtgagggaagggccctggcagcccccagcccgcctgcacagtctcccctgcgcacgccctcaagcttggcgctccctggaaacctgagctgcctcctgcctgctccggccaccgccatgtttaactgagcacgggcagccgctggccaccgccgccgcaccctggcccaccccctggctgggaggtggtcattgggcctggccttgcctgcatggtcccctggcccagagccctacctgcaggatgccagaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737257 - DNA, 1670 bp, Homo sapiens
tggggtggcagcctgggtcggccagagagttcaggccaccccggccggacgcctgccacttgctgtcactgtgccgctgtcatggcacgctccgggagtgccacgccacctgcccgggctccgggagcccctccacggagcccaccccagaggctggtacaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737258 - DNA, 1614 bp, Homo sapiens
tggggtggcagcctgggtcggccagagagttcaggccaccccggccggacgcctgccacttgctgtcactgtgccgctgtcatggcacgctccgggagtgccacgccacctgcccgggctccgggagcccctccacggagcccaccccagaggctggtacaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagccgcggggcgagggcctttgctgctctgccggggcctgctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737259 - DNA, 1637 bp, Homo sapiens
tggggtggcagcctgggtcggccagagagttcaggccaccccggccggacgcctgccacttgctgtcactgtgccgctgtcatggcacgctccgggagtgccacgccacctgcccgggctccgggagcccctccacggagcccaccccagaggctggtacaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737260 - DNA, 2129 bp, Homo sapiens
ggcagggcctgggatggtagcggggggtccttccgggcaccaggaggccctctgtgccctgtccacactaagctcctgccccagcccctgcttgctgggcccacgggggtggggcggctcattttcctggaatgtgaaagcaaacagagccgccaccgcagccagccccacggaggcctctggagagaaaacaaaactgctggcctaggagcgcctgccccacgctctggaggagagcccggggcagggggacgcacaggcagagccctcagggacaaccgccccaggaggccgacggcgacagttcatcccacctggtgcttcctcccaccctgcctgtgcgccacgctggcctcgagccaaaggaattctcccagcaacccgggaaggcggctgggcccgtcggggaggcttctgggtttgaaaacaggctttgcccaagttcccacagctaaagctctgtcacaggcagcctgggtgcccggagtgtttgccactgagacctgggcctgcccgtggggggcacggtaccgagtttgggcagtggcggcaccaccggggagtggcctctggaggcgggaggctggagcaagagactgaccctgtccgttgggcctgcaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737261 - DNA, 1394 bp, Homo sapiens
tcgcggaaatctctgacacgccgcagacatcctaggaccctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttgggacgcgctctaaataattgcaataaaacaaacctttctctgcaaaaaaaagaaaaaaacacagaaaaaagaaaaaaagggggcggcccgcaacaagagtattccccagggagggcggcccaggttaaagcgggatccccagggttaccgtggcacacaagggtggcccccaattgcggggcagccagcaatatatataaacggcacaaaggcgaccatgttgtgggcgcccgtgacttgtattaaacaacaccgtgttgatcggaacacttggggttggaaaaaaacttggggagcataatccgtgagggaaaaccatgtggaggggaaacgagggaaccctctatacaattattggtgtggtgtgttggggtgaccccataatcgttgggggccagcaagatataaccctaatcagggcgcagatttttgagaagcacgccctgtgagaggggcgaagacaatagt

SEQ ID NO: 737262 - DNA, 1965 bp, Homo sapiens
aaaaacaacatcaaacagaacatagtaaatatatctgtaatgtatacttttttctagtttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctataaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgcagacacggtaca

SEQ ID NO: 737263 - DNA, 487 bp, Homo sapiens; identical to SEQ ID NO: 43319

SEQ ID NO: 737264 - DNA, 1869 bp, Homo sapiens
  misc_feature (1800)..(1800): n is a, c, g, or t
  misc_feature (1839)..(1839): n is a, c, g, or t
  misc_feature (1843)..(1843): n is a, c, g, or t
  misc_feature (1853)..(1853): n is a, c, g, or t
  misc_feature (1866)..(1866): n is a, c, g, or t
gtgcccgcccgacggggccgccctgagcatgggtgtgcagacgtatcctcgagaccctgttcagtgttttgggtgtacgcccaggagacgaattgctggatgctgtggcaattctatgtttacttgtttgaggagcttccatggtagctgcaccatttcacattcccgccaacagtgcacgagggttccaagcgctccacgacgctcgctcgttgcctttgtgttttgtttctatagcagccatcccaacgggtgaggtgagcaccgcttcgtggatttatcagctacttgtgtgtcttctttggataaatgttgattcaagtcctttggccatttttgaatcagggttttttttgtttgttttttttttttttttttgagttttaggagttctctatagattctggtttttaaccccttactagatgcatgatttgtaaatattttccccattgtgtgctctgccgttttactcttaatgtcatttgatggacgaaatgtttttgtttccacgcagtcccgctgtctgctttttctgttgtcgcctgggcctttggtgtcaccttcaagaagtcactgccaaatccaacatcgtggcagttttccctgtgtttccttatgagaggtttaggtctcacatttaggtctttgatgtactttgcactgatttttgtcagctgtaaagtaggggccaatttcattcctttgcgtgtggatgtcctgtttcccagcaccatcggtggaagcggctgtcttttcccattgaggagtcctgccatcctggcacctgtgccaaagcccattcgaccttgagtttgagggtttatttctgggtcctcgcctctgttcccttggtccatacaccacctttatatcaggacggtgatgctttcattcctgtggcttggcagtaaaattttgaatcaggaaatgtgagtctccagcttcgttctttttaggattgttttgggtaatcaggaacccttgagattccatgtgaatttagggtgggtttttctgtttctctgagaaatatccttgagattctcccaggaagatatattgttttgagggctttaaaactccctataaatattgctgtactttgggggcccttttcttcccacactgtgtttttgagatttacccatgctgttgtgagtacctcgctgaatgcagcacatactgcatcatacaagtgcatcctgatccatttcccctgacggacgtgttcattttttgttatggcaatgctgcaatacacgtttttagctgtgcctctttgtgcttgaatgtgaggggttttctaaggtgtgaacctcagaacagagtcgccaggccatagggtgtgcacagcctccgtctgtcctgggcggccccacgcgggctccacactggtttccgtctgtcctgggcagcaccacggtggctccacactggtttccacactggtttccgtctgtcctgggcggccccgcgcgggccccacactggttgtgcgtttctcaggccaccagcagcgtccaagagctctggccgatctgcctccctccctgcgtctcggcatctttgtctggcactgctgatggttttgcctaaacggctctttgctgtggggcatcctgtgcaccgtgggacgtcttgtgcactgtggggtgttgagccgcatccgtggtctccacccacagatgacaacgacacccccagctatgaaaccagaaatgactccacacattgccaaatgtcccccagggcaaagtcacccacttgggcgttatgttacccactgatgatctgatnttcattgaggagtcactcccagctacaacctgtcacttncagnataagaaagngaagtacacatcncgt

SEQ ID NO: 737265 - DNA, 2087 bp, Homo sapiens
gtgcccgcccgacggggccgccctgagcatgggtgtgcagacgtatcctcgagaccctgttcagtgttttgggtgtacgcccaggagacgaattgctggatgctgtggcaattctatgtttacttgtttgaggagcttccatggtagctgcaccatttcacattcccgccaacagtgcacgagggttccaagcgctccacgacgctcgctcgttgcctttgtgttttgtttctatagcagccatcccaacgggtgaggtgagcaccgcttcgtggatttatcagctacttgtgtgtcttctttggataaatgttgattcaagtcctttggccatttttgaatcagggttttttttgtttgttttttttttttttttttgagttttaggagttctctatagattctggtttttaaccccttactagatgcatgatttgtaaatattttccccattgtgtgctctgccgttttactcttaatgtcatttgatggacgaaatgtttttgtttccacgcagtcccgctgtctgctttttctgttgtcgcctgggcctttggtgtcaccttcaagaagtcactgccaaatccaacatcgtggcagttttccctgtgtttccttatgagaggtttaggtctcacatttaggtctttgatgtactttgcactgatttttgtcagctgtaaagtaggggccaatttcattcctttgcgtgtggatgtcctgtttcccagcaccatcggtggaagcggctgtcttttcccattgaggagtcctgccatcctggcacctgtgccaaagcccattcgaccttgagtttgagggtttatttctgggtcctcgcctctgttcccttggtccatacaccacctttatatcaggacggtgatgctttcattcctgtggcttggcagtaaaattttgaatcaggaaatgtgagtctccagcttcgttctttttaggattgttttgggtaatcaggaacccttgagattccatgtgaatttagggtgggtttttctgtttctctgagaaatatccttgagattctcccaggaagatatattgttttgagggctttaaaactccctataaatattgctgtactttgggggcccttttcttcccacactgtgtttttgagatttacccatgctgttgtgagtacctcgctgaatgcagcacatactgcatcatacaagtgcatcctgatccatttcccctgacggacgtgttcattttttgttatggcaatgctgcaatacacgtttttagctgtgcctctttgtgcttgaatgtgaggggttttctaaggtgtgaacctcagaacagagtcgccaggccatagggtgtgcacagcctccgtctgtcctgggcggccccacgcgggctccacactggtttccgtctgtcctgggcagcaccacggtggctccacactggtttccacactggtttccgtctgtcctgggcggccccgcgcgggccccacactggttgtgcgtttctcaggccaccagcagcgtccaagagctctggccgatctgcctccctccctgcgtctcggcatctttgtctggcactgctgatggttttgcctaaacggctctttgctgtggggcatcctgtgcaccgtgggacgtcttgtgcactgtggggtgttgagccgcatccgtggtctccacccacagatgacaacgacacccccagctatgaaaccagaaatgactccacacattgccaaatgtcccccagggcaaagtcacccacttgggcgttatgttacccactgatgatctgaatttttgtccatttcacctgtctgagtttgtgtgtctctgagcactggtgggactgagcgtgtccgtggcttgtggccactcctgcttcctgtttgtgaattttatgttcataacgtctgcccctttctttgggtttttcactttattcttattattttgtaaattccttaagtattctggatacttaccttttgttattctattctagtagtcactgtccccaaaacaatgttcataaatttgttcttataaagatgagaaataaaaaacattgaattttaaactgca

SEQ ID NO: 737266 - DNA, 735 bp, Homo sapiens
gtggtgttcggttttctgttcctgtgttagtttgctgggaatgatggtttccagcttcatccatgtccctgcaaaggacatgaacacattcttttttatggctgtgcagtattatttgtccctagctggcccctttccttggcaatttctttaacctctaatccatcccacaagcatccttcactctcagaagttgattttgactctttctggtttctcttggcctatatccagtactaagacatttaaaaaatcttcttaaatcccgtgctttccattctctctgcagttgctctacttcaggtcttcatcatttaacttggctattatatggtcttccagttgttctcctgtctctaagctccatccacaccctcaccctgccactacatacacacttgctgaaaccaacatacccatcttctaaaaactatagacttcaattaattgctcccctacttaaaaatctttagtgattcatgactcccttcaaaataaagcttagtgtccttagtatgtcttaaaaggtccatcacaaagcctcgatctgtttctcaaacattgactccactgcttcactggttatcaccaacacttcaatcacatacaatggctgcctccacaatatgccgtatactattttagctctgtgctagtctacctttccccaccgccccccgcccccccagaatgcctattgcttctctcctttgtgggaaaaccccacttttcctt

SEQ ID NO: 737267 - DNA, 497 bp, Homo sapiens
tttttttttttaccaaatgtgatgtataacttgattgtgacaacaagagagtagaaatttaagtatggtgagtcagctgtttattatcagagagattcataatcaaaagagtcatagagtgggaaaactgacatatttcaacaaatctagtccagaatgttaaatagcacaatgggaaaatgtcaatgaggcacaactaaatgaaaattatctcattgcatacaacctcaatttcaaccattagaaaacactgggttgttttcaaatcacagtgtggtgctacaaagaaagcagttgagtgtttatgtaatacaatattgtgaaagcttgtggaaaacttttcttaaaatttttaaggccttggccaggcgcattggttcacgcctgtaattgagcactttgggaggccgagacgggtggatcacgaggtcaggagattgagaccatcctggctaacacggtgaaaccccatctctactaaaaatacaaaaaaaaat

SEQ ID NO: 737268 - DNA, 915 bp, Homo sapiens
cctgcccacccctagctctggggccttgagagaggcaagcacacgctcttctcgcctccagagagcggcgtgggggtgtggatactgctcaggccctggcatctcgcacgcctaggaccagcctctgccattcacaggaccgtgcaggcggccccaacagaggacggggacagctctctccttctgtaagtgaggcagcctcatccttccctggatcctcagcatctcttaaccagcagtggcagaggttgaattagaatggcaccagcttcggataaaaatccagatctcgcttttcaaaatgtgtctagagctggtggctgtaaggaaccagtcaagcctcagctgtgactctaatcctgccaagtccacctgagagccgactcattcatccaaagagagaacggtttggatggagctcaaggtgcctggctcgctggcatagcccagacaacctcttaaaggccgggccacagagctagaaggtctgtcactactcagttggggaaatcgtctgagaagttcaagtccactgcctcgcaactcaaatgagtcagcctcaccaaccaagaatcgcgttcataaacagactcagagcctgcgtgccgtggggtttccccgtctgcaactctctcacctggccctcctgcagggcccggcggggactggggagggtcagtgctccctggggcggggactgggtctgtttccaggctcagtgcctctgagtcatacagatgccaggtggtcctgctgcttaccctcgctgaacctcaggcttctcgtgtaaacagggcgcttttgaggaattattattaacatctccctgtgagtcaaagcacctactgagataatgtatgtgatgcttgtaataaatgcagctacatgccaggcactctgaaaaactgcctttgt

SEQ ID NO: 737269 - DNA, 830 bp, Homo sapiens
ctgacaggcaagtttcaagacagtggctaagcccaggtcctgaagagaggaggaccgtgcaggcggccccaacagaggacggggacagctctctccttctgtaagtgaggcagcctcatccttccctggatcctcagcatctcttaaccagcagtggcagaggttgaattagaatggcaccagcttcggataaaaatccagatctcgcttttcaaaatgtgtctagagctggtggctgtaaggaaccagtcaagcctcagctgtgactctaatcctgccaagtccacctgagagccgactcattcatccaaagagagaacggtttggatggagctcaaggtgcctggctcgctggcatagcccagacaacctcttaaaggccgggccacagagctagaaggtctgtcactactcagttggggaaatcgtctgagaagttcaagtccactgcctcgcaactcaaatgagtcagcctcaccaaccaagaatcgcgttcataaacagactcagagcctgcgtgccgtggggtttccccgtctgcaactctctcacctggccctcctgcagggcccggcggggactggggagggtcagtgctccctggggcggggactgggtctgtttccaggctcagtgcctctgagtcatacagatgccaggtggtcctgctgcttaccctcgctgaacctcaggcttctcgtgtaaacagggcgcttttgaggaattattattaacatctccctgtgagtcaaagcacctactgagataatgtatgtgatgcttgtaataaatgcagctacatgccaggcactctgaaaaactgcctttgt

SEQ ID NO: 737270 - DNA, 643 bp, Homo sapiens
  misc_feature (545)..(545): n is a, c, g, or t
  misc_feature (590)..(590): n is a, c, g, or t
  misc_feature (622)..(622): n is a, c, g, or t
  misc_feature (641)..(641): n is a, c, g, or t
tctagggcacttggaggtcctaaaactgctggtggcacggggagcagacctcggctgcaaggaccgcaagggctatgggctgctccatacagctgctgccagtggccagattgaagtggtgaagtacctgcttcggatgggagcggagatcgatgaacccaatgcttttggaaacacagctttgcacatcgcctgctacctgggccaggatgctgtggctattgagctggtgaatgccggagccaatgtcaaccagccgaatgacaagggcttcacgccactgcatgtggctgcagtctcgaccaatggcgctctctgcttggagctactggttaataatggggctgacgtcaactaccagagcaaagaagggaaaagtcctctgcacatggctgcaatccatggccgtttcacacgctcccagatcctcatccagaatggcagcgagattgattgtgccgacaaatttgggaacacgccactgcatgtggctgctcgatatggacacgagctgctcatcagcaccctcatgaccaatggcgcanataccgcccggcgtggcatccatgacatgttccccctgcacttanctgttctctttggattctctgactgttgtcgnaagcttctttcctcaggtntg

SEQ ID NO: 737271 - DNA, 790 bp, Homo sapiens
aatgctaaggacacactgtggctgacccctcttcatcgtgctgctgcctcccgaaacgagaaggtgctggggctgctgctggcacattcagcagatgtgaatgcccgggacaagctgtggcagacaccactgcatgtggctgctgccaaccgggccaccaagtgtgctgaggctctggcacccctgttgagcagcctcaacgtggctgacaggagcgggcgcagtgccctgcaccatgcagtgcatagtgggcatcttgagacggtgaacctgctcctcaacaagggagccagcctgaatgtctgtgacaaaaaggagcggcagcctctgcattgggcagcttttctagatcgatgaacccaatgcttttggaaacacagctttgcacatcgcctgctacctgggccaggatgctgtggctattgagctggtgaatgccggagccaatgtcaaccagccgaatgacaagggcttcacgccactgcatgtggctgcagtctcgaccaatggcgctctctgcttggagctactggttaataatggggctgacgtcaactaccaggtgcctgaagggataaggcttagaccagtggggagcgaaacttggatctaggggtcctgactgtatctggatagctctcttggggaattatccacttgcttcctagggtaatcagaccttgccagggactcaggaaagagtgggctaagaaggtgccatatgacccttttgtccttagagatatgtccttggaagggaggtagggcattctctgtgctttgcactgga

SEQ ID NO: 737272 - DNA, 739 bp, Homo sapiens
ctattcctccttccatttcctgttgttttacctcctgctcccactctctcttttgtcccctgcccctcaacagaaggtgctggggctgctgctggcacattcagcagatgtgaatgcccgggacaagctgtggcagacaccactgcatgtggctgctgccaaccgggccaccaagtgtgctgaggctctggcacccctgttgagcagcctcaacgtggctgacaggagcgggcgcagtgccctgcaccatgcagtgcatagtgggcatcttgaggtgaggactgttcccatccaggcccagctggggctttcccttttcttaccttcctactcacgtttccctgcttctgggccctcaagcctgaaggagaagcagcccggatggttatataaacacttaagctgaagcactaaatgaatggtcagactagattaaaattcttaacttggacttcaggaggttgataaaaccttggattttgcgtggaaaatatttgcatacacgcctttctgaagagagtccatgtctttcagcacatttgcaaagacttacaagagtttaagaaccggccgggcacggcggctcacgcctgtaatcccagcactttgggaggcgaaggcgggtggatcatgagatcaggagatcgagatcatcctggctaacatggtgaaaccctgtctctactaaaaatacaaaaaattagccgggtgtggtggcggccgcctgtagtcccagcta

SEQ ID NO: 737273 - DNA, 737 bp, Homo sapiens
ctattcctccttccatttcctgttgttttacctcctgctcccactctctcttttgtcccctgcccctcaacagaaggtgctggggctgctgctggcacattcagcagatgtgaatgcccgggacaagctgtggcagacaccactgcatgtggctgctgccaaccgggccaccaagtgtgctgaggctctggcacccctgttgagcagcctcaacgtggctgacaggagcgggcgcagtgccctgcaccatgcagtgcatagtgggcatcttgaggtgaggactgttcccatccaggcccagctggggctttcccttttcttaccttcctactcacgtttccctgcttctgggccctcaagcctgaaggagaagcagcccggatggttatataaacacttaagctgaagcactaaatgaatggtcagactagattaaaattcttaacttggacttcaggaggttgataaaaccttggattttgcgtggaaaatatttgcatacacgcctttctgaagagagtccatgtctttcagcacatttgcaaagacttacaggcgtgagccaccgtgcccagccacatctttttttctaacagaaaaacaaacaaaacaaacaaaaacaaaccttgagtaccatattcttagttctctgtttggctactggaaattctgcgctttgcccatcttgacctctaatagctaaaggaaatgtggttgagaaccactgatagaggaga

SEQ ID NO: 737274 - DNA, 390 bp, Homo sapiens
ctattcctccttccatttcctgttgttttacctcctgctcccactctctcttttgtcccctgcccctcaacagaaggtgctggggctgctgctggcacattcagcagatgtgaatgcccgggacaagctgtggcagacaccactgcatgtggctgctgccaaccgggccaccaagtgtgctgaggctctggcacccctgttgagcagcctcaacgtggctgacaggagcgggcgcagtgccctgcaccatgcagtgcatagtgggcatcttgagacggtgaacctgctcctcaacaagggagccagcctgaatgtctgtgacaaaaaggagcggcagcctctgcattgggcagcttttctagacctccaagtgccctagttctagatcgc

SEQ ID NO: 737275 - DNA, 732 bp, Homo sapiens
aggatctttaagtagtggtgttgagctgaacgctttctattttgtgactggtttctttcacttagcataatgtttttaaggatcatttgtgttgtgtgtatcagtatttcatttctttttatggctgaatgttgtatgcatacatcaccttttgtttatccattcatcagctgatggacgtttggattgtttctgtcttttgactattagaaacaaggatatgaatatatataagttttgtatagatatatattttcacttttcttacaaatatatcaaggaacagaattgttggagcatatggttactactccgtgtttaattttttgaggaacctccctactggtttccaaagtggctgcaccattatacatcccactatcagtctatgagcatttcagtttttccacacactccttaaaactcatctgactttttgtatttagccatcatactggatgttaagtggtatcttattgtgatttcgatttacatttgcctaatggccaatgatgttgaacatttcatgttcttcttaggtcattggtatgtcttctttggagaaatgtctgtttaagtacttcaaaattgagctatttttcttcttattagtgagttgtaatagttatttatatgtactagatagaagacctgtgtcagatatatgatttacaaatatttggcttgtcttttactttctaatagccgcatccaaccgggtcctcagaacac

SEQ ID NO: 737276 - DNA, 2421 bp, Homo sapiens
  misc_feature (771)..(771): n is a, c, g, or t
  misc_feature (848)..(848): n is a, c, g, or t
  misc_feature (2199)..(2199): n is a, c, g, or t
gtgacagttgatgacttagatgatggagcgaatggagagatcgaatctgtttccattgtggctggggatcctttagatcagttcttcctggctaaggaaggaaagtggttgaatgagtacaagattaaggagaggaagcagattgactgggagagctttccctatggctacaatctcactcttcaagcaaaagacaagggatctcctcaaaaatgttcagcattaaaggcagtctacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatctcctggtgaggatgcagtgtactttaaaattaatcctcggtcgggtctgattgttacagcacggccactgaatactgttaagaaggaggtttataaactggaggtgacaaacaaggaaggagatttaaaagcacaggtcaccatcagcatagaagatgcaaatgaccacaccccagaatttcagcaaccactgtatgatgcttatgtgaatgaaagtgtcccagtgggaaccagcgttctaacagtttcagcttctgataaggataaaggagaaaatgggtacatcacctatagtatcgctagcctgaatttgttaccatttgtcattaatcagtttacaggtgttattagcacaactgaagaactggattttgaatcctccccaganatttacagattcattgttagagcctctgactggggttcaccataccgccatgaaagtgaggtcaatgtgactattcnaataggaaatgtcaacgacaacagccctctctttgaaaaagtggcttgccagggagttatttcatatgactttccagttggtggtcacatcacagcagtctcagcgatcgatatcgatgaacttgaacttgtaaagtacaaaatcatttctggaaatgaacttggcttcttttatttaaacccagattctggtgttttacagcttaaaaaatcactgacaaattctggcattaaaaatggcaattttgccctcagaattacagcaactgatggagagaatcttgcagaccccatgtctattaacatttcagtcctacatgggaaagtgtcttcaaagagcttcagttgcagagaaactcgtgtggctcaaaagctggcagagaaactactcattaaggcaaaagcaaatgggaaactgaatctggaagatggatttcttgacttttattcaattaatagacagggaccatattttgacaagtcttttccttctgatgtggctgtaaaggaggatctgccagttggtgctaacattctgaagattaaagcctatgatgccgactctggcttcaatggaaaagtgctatttacaatatcagatggaaatacggatagttgctttaatattgatatggagactgggcagcttaaagtccttatgcccatggatcgagaacacacagacctctatctccttaatatcaccatctatgacttaggtaatccacagaaatcgtcatggagactgctgaccatcaatgtggaggatgctaatgacaatagcccagtttttattcaagacagttactcagttaacattcttgaaagttcaggcattggtactgaaatcattcaagtggaagccagagacaaagacttaggttctaatggtgaagtgacttactcagtcttgacagatacacagcagtttgccatcaatagctcaactggaatcgtttatgtagccgaccagttggaccgggaatccaaagccaattattctttgaaaatagaagccagggacaaggcagagagtggtcagcagctgttttcagttgtcactcttaaagtttttttagatgatgtcaatgactgctccccagctttcattcccagtagctatagtgtgaaggttcttgaagatctccctgttggcactgtcattgcttggcttgagacccatgatccagattgcgctattctttggtcaatgactataatgggagatttgaaatagataaagcaagtggtgccatccgcttgagcaaagagctttccctatgggtacaatttcactcttcaagcaaaagacaagggatctcctcaaaaatgttcagcattaaaggcagtntacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatttcctggtgaggatgcagtgtagagtgctgtagctgtgtgttccaataaattattttgtagggaaaaaaaaaaa

SEQ ID NO: 737277 - DNA, 3119 bp, Homo sapiens
  misc_feature (771)..(771): n is a, c, g, or t
  misc_feature (848)..(848): n is a, c, g, or t
  misc_feature (2749)..(2749): n is a, c, g, or t
  misc_feature (2839)..(2839): n is a, c, g, or t
gtgacagttgatgacttagatgatggagcgaatggagagatcgaatctgtttccattgtggctggggatcctttagatcagttcttcctggctaaggaaggaaagtggttgaatgagtacaagattaaggagaggaagcagattgactgggagagctttccctatggctacaatctcactcttcaagcaaaagacaagggatctcctcaaaaatgttcagcattaaaggcagtctacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatctcctggtgaggatgcagtgtactttaaaattaatcctcggtcgggtctgattgttacagcacggccactgaatactgttaagaaggaggtttataaactggaggtgacaaacaaggaaggagatttaaaagcacaggtcaccatcagcatagaagatgcaaatgaccacaccccagaatttcagcaaccactgtatgatgcttatgtgaatgaaagtgtcccagtgggaaccagcgttctaacagtttcagcttctgataaggataaaggagaaaatgggtacatcacctatagtatcgctagcctgaatttgttaccatttgtcattaatcagtttacaggtgttattagcacaactgaagaactggattttgaatcctccccaganatttacagattcattgttagagcctctgactggggttcaccataccgccatgaaagtgaggtcaatgtgactattcnaataggaaatgtcaacgacaacagccctctctttgaaaaagtggcttgccagggagttatttcatatgactttccagttggtggtcacatcacagcagtctcagcgatcgatatcgatgaacttgaacttgtaaagtacaaaatcatttctggaaatgaacttggcttcttttatttaaacccagattctggtgttttacagcttaaaaaatcactgacaaattctggcattaaaaatggcaattttgccctcagaattacagcaactgatggagagaatcttgcagaccccatgtctattaacatttcagtcctacatgggaaagtgtcttcaaagagcttcagttgcagagaaactcgtgtggctcaaaagctggcagagaaactactcattaaggcaaaagcaaatgggaaactgaatctggaagatggatttcttgacttttattcaattaatagacagggaccatattttgacaagtcttttccttctgatgtggctgtaaaggaggatctgccagttggtgctaacattctgaagattaaagcctatgatgccgactctggcttcaatggaaaagtgctatttacaatatcagatggaaatacggatagttgctttaatattgatatggagactgggcagcttaaagtccttatgcccatggatcgagaacacacagacctctatctccttaatatcaccatctatgacttaggtaatccacagaaatcgtcatggagactgctgaccatcaatgtggaggatgctaatgacaatagcccagtttttattcaagacagttactcagttaacattcttgaaagttcaggcattggtactgaaatcattcaagtggaagccagagacaaagacttaggttctaatggtgaagtgacttactcagtcttgacagatacacagcagtttgccatcaatagctcaactggaatcgtttatgtagccgaccagttggaccgggaatccaaagccaattattctttgaaaatagaagccagggacaaggcagagagtggtcagcagctgttttcagttgtcactcttaaagtttttttagatgatgtcaatgactgctccccagctttcattcccagtagctatagtgtgaaggttcttgaagatctccctgttggcactgtcattgcttggcttgagacccatgatccagatcttggactggggggtcaagtgcgctattctttggtcaatgactataatgggagatttgaaatagataaagcaagtggtgccatccgcttgagcaaagagcttgattatgagaaacagcagttctataaccttactgtgcgggccaaagacaaagggcggcctgtctctctgtcatctgtttcctttgttgaggtggaagtggtggatgtcaatgaaaacctccacactccctatttcccagactttgctgttgttggatctgtaaaggaaaactcacgcattggaacaagcgtgctgcaggtgactgctcgagatgaagactccggaagggatggagagatccagtactccatcagggatggcagtggtcttggaaggttcagtatagacgacgagagtggtaagtgtaatattttgtgccaagagtgttgtttcacctcttttaaatggtcaacagtggaaaagtaaagggatgttaggacactaaaatagaatgacaaatgaggttgcatttggtgcagagacgacgcacatagatgctttttcttaggatgttctggtttgttagaagatctgtttataaactaacagctgtggtttccagtgggagtcctggtttgttttgttttgttattttcttgctcagcactattgctaccaggtcatcttttgataagcctaagtaattgtcacttctgttgattgtacncctgaccctctctaaatgaaggactctgataaagtaaattacatttgaattggctttaagttagaagtgtgaaatggattttcaaatggntcttatataggaatctttccctttacagtaaggctttgcagaagtgatattgcattagttgcttggtcttttatctttcatgggttcatctggtccttgaatgatgggcatttgcactctgtagctccattaatataaggaggtgtgcttctacaaatgttttcttaatggaataaatgagtcttgctatgaattttatttataaaaattgattttaagaatttatttgtaaggagatatttacaaaacattaaaaaatatggggcaacattgttccagt

SEQ ID NO: 737278 - DNA, 3804 bp, Homo sapiens
  misc_feature (771)..(771): n is a, c, g, or t
  misc_feature (848)..(848): n is a, c, g, or t
  misc_feature (3804)..(3804): n is a, c, g, or t
gtgacagttgatgacttagatgatggagcgaatggagagatcgaatctgtttccattgtggctggggatcctttagatcagttcttcctggctaaggaaggaaagtggttgaatgagtacaagattaaggagaggaagcagattgactgggagagctttccctatggctacaatctcactcttcaagcaaaagacaagggatctcctcaaaaatgttcagcattaaaggcagtctacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatctcctggtgaggatgcagtgtactttaaaattaatcctcggtcgggtctgattgttacagcacggccactgaatactgttaagaaggaggtttataaactggaggtgacaaacaaggaaggagatttaaaagcacaggtcaccatcagcatagaagatgcaaatgaccacaccccagaatttcagcaaccactgtatgatgcttatgtgaatgaaagtgtcccagtgggaaccagcgttctaacagtttcagcttctgataaggataaaggagaaaatgggtacatcacctatagtatcgctagcctgaatttgttaccatttgtcattaatcagtttacaggtgttattagcacaactgaagaactggattttgaatcctccccaganatttacagattcattgttagagcctctgactggggttcaccataccgccatgaaagtgaggtcaatgtgactattcnaataggaaatgtcaacgacaacagccctctctttgaaaaagtggcttgccagggagttatttcatatgactttccagttggtggtcacatcacagcagtctcagcgatcgatatcgatgaacttgaacttgtaaagtacaaaatcatttctggaaatgaacttggcttcttttatttaaacccagattctggtgttttacagcttaaaaaatcactgacaaattctggcattaaaaatggcaattttgccctcagaattacagcaactgatggagagaatcttgcagaccccatgtctattaacatttcagtcctacatgggaaagtgtcttcaaagagcttcagttgcagagaaactcgtgtggctcaaaagctggcagagaaactactcattaaggcaaaagcaaatgggaaactgaatctggaagatggatttcttgacttttattcaattaatagacagggaccatattttgacaagtcttttccttctgatgtggctgtaaaggaggatctgccagttggtgctaacattctgaagattaaagcctatgatgccgactctggcttcaatggaaaagtgctatttacaatatcagatggaaatacggatagttgctttaatattgatatggagactgggcagcttaaagtccttatgcccatggatcgagaacacacagacctctatctccttaatatcaccatctatgacttaggtaatccacagaaatcgtcatggagactgctgaccatcaatgtggaggatgctaatgacaatagcccagtttttattcaagacagttactcagttaacattcttgaaagttcaggcattggtactgaaatcattcaagtggaagccagagacaaagacttaggttctaatggtgaagtgacttactcagtcttgacagatacacagcagtttgccatcaatagctcaactggaatcgtttatgtagccgaccagttggaccgggaatccaaagccaattattctttgaaaatagaagccagggacaaggcagagagtggtcagcagctgttttcagttgtcactcttaaagtttttttagatgatgtcaatgactgctccccagctttcattcccagtagctatagtgtgaaggttcttgaagatctccctgttggcactgtcattgcttggcttgagacccatgatccagatcttggactggggggtcaagtgcgctattctttggtcaatgactataatgggagatttgaaatagataaagcaagtggtgccatccgcttgagcaaagagcttgattatgagaaacagcagttctataaccttactgtgcgggccaaagacaaagggcggcctgtctctctgtcatctgtttcctttgttgaggtggaagtggtggatgtcaatgaaaacctccacactccctatttcccagactttgctgttgttggatctgtaaaggaaaactcacgcattggaacaagcgtgctgcaggtgactgctcgagatgaagactccggaagggatggagagatccagtactccatcagggatggcagtggtcttggaaggttcagtatagacgacgagagtggggtcatcactgccgcagacattcttgatcgggagacaatggggtcatactggctaacagtgtatgccacagacaggggcgttgttccactctactccaccattgaggtctacattgaagttgaagatgtgaatgacaatgccccgctgacctcagaacctatatattatcctgttgtcatggaaaactctccaaaggacgtatctgtcattcagatccaggctgaagatcctgactccagttccaatgaaaaactgacatacaggattacaagtggaaatcctcagaatttttttgccatcaatatcaaaacagggtcttgctctgttgcccaggctggaatgcagtggcatgatcgtagctcactgcaatctcgaactcctggattcaagggatacccctgcctcagcctcttgagtagctgggactataggcatgcaccgccatgcccagctacttttttaaatagttgagagtctcactatgttgcccaagctggtcttgatctcctggtcccaaatgatcctcttcctctgcctcccaagcactggaattacaggcatgagccactgtgcccagcccttatgctggacatttcatatgaatttcatgtaagtggaatcacgtaacatatagtattttgtgactggtttctttcacttagcataatgtttttaaggatcatttgtgttgtgtgtatcagtatttcatttctttttatggctgaatgttgtatgcatacatcaccttttgtttatccattcatcagctgatggacgtttggattgtttctgtcttttgactattagaaacaaggatatgaatatatataagttttgtatagatatatattttcacttttcttacaaatatatcaaggaacagaattgttggagcatatggttactactccgtgtttaattttttgaggaacctccctactggtttccaaagtggctgcaccattatacatcccactatcagtctatgagcatttcagtttttccacacactccttaaaactcatctgactttttgtatttagccatcatactggatgttaagtggtatcttattgtgatttcgatttacatttgcctaatggccaatgatgttgaacatttcatgttcttcttaggtcattggtatgtcttctttggagaaatgtctgtttaagtacttcaaaattgagctatttttcttcttattagtgagttgtaatagttatttatatgtactagatagaagacctgtgtcagatatatgatttacaaatatttggcttgtcttttactttcttgataggggcatttgaagaacaatgggttttcattttaattttaataaagtctagtttttttttn

SEQ ID NO: 737279 - DNA, 769 bp, Homo sapiens; identical to SEQ ID NO: 408059

SEQ ID NO: 737280 - DNA, 832 bp, Homo sapiens
  misc_feature (812)..(812): n is a, c, g, or t
tttgcttttctctctgatctgactaacctctttcattctttgccctatgttatatggcttagaccaaagcctgagacatttaaccaatttataaatattaaatgcagaaggcatactttatcagttcctggaaacatcaaagaagctggaaggggaatggaaattggatggcactttgtggaggtcactttgctgacagtcaagtattcaaaggatgaaggctcagatcagtttcatctatatgctatgcctgcctgacctggagaacttggtgttaaaggaaatgtgtttatcaaatgtgtcatgttatccttggagggcaactgaggatcagagcacagctgccttgaattgttccatcgagttattccactgcagttaagtggaacatcaaaaaacgtcaagaagcctaaaacatggaaacttgtttaattttctcaaacaatggcactaaccaaagcaaacgaaactttgacaagaaagaagcaattgtttagccttgtcatgtcctcacagttaataatacaaagggtatattcacagtgcaaagatactttccctttctctcaaaatagaagactacgtattgtaagatattttacagatgtccttcctcatagaactctgtaaactttactagctcaagaacaaaatcaaagtttcaattcacgggactgattcatcttgcattttaggtattctaatggtatatttgtactgtgtgttgcaacctatagaataaatgtacttcttcttcatgtttcctgtttgctgatgacagataccagtggctcacctttcggcctatgaancaatgattcttttcaaattg

SEQ ID NO: 737281 - DNA, 962 bp, Homo sapiens
cctggccttggttggtgtcctcatccttttcatgttcagaaggcttagacaatttcgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccggccctgcagcccaaggagcccccgccctccctgctggaggccgacctcacggagtttgacgtgaagaattctcacctgccatcggaagttctgtacatgctgaaaaacgttcgggtcctgggccactttgagaagccgctgttcctggagctttgcaaacacatcgtctttgtgcagctgcaggaaggggagcacgtcttccagcccagggagccggaccccagcatctgtgtggtgcaggacgggcggctggaggtctgcatccaggacactgacggcaccgaggtggtggtgaaagaggttctggcgggagacagcgtccacagcctgctcagcatcctggacatcatcaccggccatgctgcaccttacaaaacggtctccgtccgcgcggccatcccgtccaccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgagagccaggccatccctctcgtgtctgtagccagtgtggctgccgggaaggccaagaagcaggtgttctatggcgaagaagagcggcttaaaaagccaccgcggctccaggagtcctgtgactcaggtactgtcctgcacc

SEQ ID NO: 737282 - DNA, 941 bp, Homo sapiens
cagtcttttcatctcagaggttacttagacaatacgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccggccctgcagcccaaggagcccccgccctccctgctggaggccgacctcacggagtttgacgtgaagaattctcacctgccatcggaagttctgtacatgctgaaaaacgttcgggtcctgggccactttgagaagccgctgttcctggagctttgcaaacacatcgtctttgtgcagctgcaggaaggggagcacgtcttccagcccagggagccggaccccagcatctgtgtggtgcaggacgggcggctggaggtctgcatccaggacactgacggcaccgaggtggtggtgaaagaggttctggcgggagacagcgtccacagcctgctcagcatcctggacatcatcaccggccatgctgcaccttacaaaacggtctccgtccgcgcggccatcccgtccaccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgagagccaggccatccctctcgtgtctgtagccagtgtggctgccgggaaggccaagaagcaggtgttctatggcgaagaagagcggcttaaaaagccaccgcggctccaggagtcctgtgactcaggtactgtcctgcacc

SEQ ID NO: 737283 - DNA, 2412 bp, Homo sapiens
ggtggaggctatcaccgagggtgtggaggaggacgagggctgttgctgctgtgaacctggccacctgccacgggtcctgtccttcaatgctgcctttgggcagcgctggctggcttgggaggtaacagccagcaagtacgtgctggagggctatagcattagtgacaataatgctgcctccatgctgcaggttttcgacctccgcaagatcctcatcacctactatgtcaagagcatcatctactacgtgagccgctcaccaaagctggaggtgtggctcagccatgagggcatcacggcagccctgaggcctgtgcgggtgcccggctatgccgactcggatcccaccttctcgctgagtgtggatgaggactatgacctccgcctgtctggcctctcgctgccctccttttgtgctgtgcacctcgagtggatccagtactgcgcctcccggcgcagccagcccgtggaccaggattggaactccccgctggtcacgctgtgttttggcctgtgtgtgctgggccgccgggccctggggacagcctctcacagcatgtctgcaagcctggagcccttcctctacggcctgcacgccctgttcaagggggattttcgcatcacctccccacgtgacgagtgggtctttgccgacatggacctgcttcaccgcgttgtggcgcctggggttcgcatggccctcaagcttcaccaggaccacttcacgtccccagatgaatatgaggagccagcagccctatacgatgccattgcggccaacgaggagcggctggtcatctcacatgagggtgacccagcatggcgcagcgccatcctcagcaacacgccctccctgctggcgctgcgccatgtcctggatgatgcctccgacgagtacaagatcatcatgctcaaccggcgccacctcagcttccgagtcatcaaggtgaaccgggagtgcgtgcgcggcctgtgggccgggcagcagcaggagctggtgttcctgcgcaaccgcaaccccgagcgtggcagcatccagaacgccaagcaggcgcttcgcaacatgatcaactcctcctgtgaccagccgctgggctaccccatctacgtgtcgcctctcaccacctcgctggctggcagccacccccagctacgggcactgtggggtggccccatcagcctgggtgccattgcccactggctcctgcgcacctgggagaggcttcacaagggctgtggcgccggctgcaatagtggcgggaacgtggatgattcagactgtagtgggggcggtggcctgacctccctcagcaataacccccccgtggcacaccccacacctgagaacacggcaggcaatggtgaccaacccctcccaccaggccctggctgggggccgcggtcctccctgagtggctctggtgatgggcggcccccacctctgctgcagtggcctccccctcggctccctggaccaccccctgcatcgcctatccccacagagggtccccggacctcacggccccctggcccgggtctcctcagttctgagggccccagtggaaagtggagcctggggggccggaaggggctgggaggatctgacggggagccagcctcagggagccccaaaggaggtacccccaaatctcaggtaaggcacctgtgggagggttgggtcccagaaggctaaggcctgctcacccgccaacctctcccccctcccccaggcgcctctagacctcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatggaggcagtcagcctcccagccaggccctaagagccaaaccatgggctggtcccacttggagcctgtggccaggaccacctcagcccctgggcctgcactgcctgcaggtgtggcccccttggcctggacctggggcctgaattgtgggaagggtggtttctttctttccttttttttcttttcttttttttttttttttttgtgcttcggagacatcagaattaataacactatttttgattttgaaaaaaaa

SEQ ID NO: 737284 - DNA, 2336 bp, Homo sapiens
ggtggaggctatcaccgagggtgtggaggaggacgagggctgttgctgctgtgaacctggccacctgccacgggtcctgtccttcaatgctgcctttgggcagcgctggctggcttgggaggtaacagccagcaagtacgtgctggagggctatagcattagtgacaataatgctgcctccatgctgcaggttttcgacctccgcaagatcctcatcacctactatgtcaagagcatcatctactacgtgagccgctcaccaaagctggaggtgtggctcagccatgagggcatcacggcagccctgaggcctgtgcgggtgcccggctatgccgactcggatcccaccttctcgctgagtgtggatgaggactatgacctccgcctgtctggcctctcgctgccctccttttgtgctgtgcacctcgagtggatccagtactgcgcctcccggcgcagccagcccgtggaccaggattggaactccccgctggtcacgctgtgttttggcctgtgtgtgctgggccgccgggccctggggacagcctctcacagcatgtctgcaagcctggagcccttcctctacggcctgcacgccctgttcaagggggattttcgcatcacctccccacgtgacgagtgggtctttgccgacatggacctgcttcaccgcgttgtggcgcctggggttcgcatggccctcaagcttcaccaggaccacttcacgtccccagatgaatatgaggagccagcagccctatacgatgccattgcggccaacgaggagcggctggtcatctcacatgagggtgacccagcatggcgcagcgccatcctcagcaacacgccctccctgctggcgctgcgccatgtcctggatgatgcctccgacgagtacaagatcatcatgctcaaccggcgccacctcagcttccgagtcatcaaggtgaaccgggagtgcgtgcgcggcctgtgggccgggcagcagcaggagctggtgttcctgcgcaaccgcaaccccgagcgtggcagcatccagaacgccaagcaggcgcttcgcaacatgatcaactcctcctgtgaccagccgctgggctaccccatctacgtgtcgcctctcaccacctcgctggctggcagccacccccagctacgggcactgtggggtggccccatcagcctgggtgccattgcccactggctcctgcgcacctgggagaggcttcacaagggctgtggcgccggctgcaatagtggcgggaacgtggatgattcagactgtagtgggggcggtggcctgacctccctcagcaataacccccccgtggcacaccccacacctgagaacacggcaggcaatggtgaccaacccctcccaccaggccctggctgggggccgcggtcctccctgagtggctctggtgatgggcggcccccacctctgctgcagtggcctccccctcggctccctggaccaccccctgcatcgcctatccccacagagggtccccggacctcacggccccctggcccgggtctcctcagttctgagggccccagtggaaagtggagcctggggggccggaaggggctgggaggatctgacggggagccagcctcagggagccccaaaggaggtacccccaaatctcaggcgcctctagacctcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatggaggcagtcagcctcccagccaggccctaagagccaaaccatgggctggtcccacttggagcctgtggccaggaccacctcagcccctgggcctgcactgcctgcaggtgtggcccccttggcctggacctggggcctgaattgtgggaagggtggtttctttctttccttttttttcttttcttttttttttttttttttgtgcttcggagacatcagaattaataacactatttttgattttgaaaaaaaa

SEQ ID NO: 737285 - DNA, 1753 bp, Homo sapiens
ggtggaggctatcaccgagggtgtggaggaggacgagggctgttgctgctgtgaacctggccacctgccacgggtcctgtccttcaatgctgcctttgggcagcgctggctggcttgggaggtaacagccagcaagtacgtgctggagggctatagcattagtgacaataatgctgcctccatgctgcaggttttcgacctccgcaagatcctcatcacctactatgtcaagagcatcatctactacgtgagccgctcaccaaagctggaggtgtggctcagccatgagggcatcacggcagccctgaggcctgtgcgggtgcccggctatgccgactcggatcccaccttctcgctgagtgtggatgaggactatgacctccgcctgtctggcctctcgctgccctccttttgtgctgtgcacctcgagtggatccagtactgcgcctcccggcgcagccagcccgtggaccaggattggaactccccgctggtcacgctgtgttttggcctgtgtgtgctgggccgccgggccctggggacagcctctcacagcatgtctgcaagcctggagcccttcctctacggcctgcacgccctgttcaagggggattttcgcatcacctccccacgtgacgagtgggtctttgccgacatggacctgcttcaccgcgttgtggcgcctggggttcgcatggccctcaagcttcaccaggaccacttcacgtccccagatgaatatgaggagccagcagccctatacgatgccattgcggccaacgaggagcggctggtcatctcacatgagggtgacccagcatggcgcagcgccatcctcagcaacacgccctccctgctggcgctgcgccatgtcctggatgatgcctccgacgagtacaagatcatcatgctcaaccggcgccacctcagcttccgagtcatcaaggtgaaccgggagtgcgtgcgcggcctgtgggccgggcagcagcaggagctggtgttcctgcgcaaccgcaaccccgagcgtggcagcatccagaacgccaagcaggcgcttcgcaacatgatcaactcctcctgtgaccagccgctgggctaccccatctacgtgtcgcctctcaccacctcgctggctggcagccacccccagctacgggcactgtggggtggccccatcagcctgggtgccattgcccactggctcctgcgcacctgggagaggcttcacaagggctgtggcgccggctgcaatagtggcgggaacgtggatgattcagactgtagtgggggcggtggcctgacctccctcagcaataacccccccgtggcacaccccacacctgagaacacggcaggcaatggtgaccaacccctcccaccaggccctggctgggggccgcggtcctccctgagtggctctggtgatgggcggccccacttgtgagtggctgccactaggtcctgacaccctggatgtatccaagagggtaccgacgctcacggccgccagacggatgtcacaatatgagggcccaacggaagtgagccgcgggcggaggcatggagaccgacggagacagcacagagcccaagaagaacccaaagacggccaaaacaaaaagagccacacagaaagcacgagaaagagcaacgcagagccgcaaccggggaccagcctaaggaccacagagggacagggcccaagagaaccgcgcgagagaagagagcacacagaaaccacaagacggacaca

SEQ ID NO: 737286 - DNA, 1908 bp, Homo sapiens
ggaccggtccggaattctcgggatggcgcagccagcccgtggaccaggattggaactccccgctggtcacgctgtgttttggcctgtgtgtgctgggccgccgggccctggggacagcctctcacagcatgtctgcaagcctggagcccttcctctacggcctgcacgccctgttcaagggggattttcgcatcacctccccacgtgacgagtgggtctttgccgacatggacctgcttcaccgcgttgtggcgcctggggttcgcatggccctcaagcttcaccaggaccacttcacgtccccagatgaatatgaggagccagcagccctatacgatgccattgcggccaacgaggagcggctggtcatctcacatgagggtgacccagcatggcgcagcgccatcctcagcaacacgccctccctgctggcgctgcgccatgtcctggatgatgcctccgacgagtacaagatcatcatgctcaaccggcgccacctcagcttccgagtcatcaaggtgaaccgggagtgcgtgcgcggcctgtgggccgggcagcagcaggagctggtgttcctgcgcaaccgcaaccccgagcgtggcagcatccagaacgccaagcaggcgcttcgcaacatgatcaactcctcctgtgaccagccgctgggctaccccatctacgtgtcgcctctcaccacctcgctggctggcagccacccccagctacgggcactgtggggtggccccatcagcctgggtgccattgcccactggctcctgcgcacctgggagaggcttcacaagggctgtggcgccggctgcaatagtggcgggaacgtggatgattcagactgtagtgggggcggtggcctgacctccctcagcaataacccccccgtggcacaccccacacctgagaacacggcaggcaatggtgaccaacccctcccaccaggccctggctgggggccgcggtcctccctgagtggctctggtgatgggcggcccccacctctgctgcagtggcctccccctcggctccctggaccaccccctgcatcgcctatccccacagagggtccccggacctcacggccccctggcccgggtctcctcagttctgagggccccagtggaaagtggagcctggggggccggaaggggctgggaggatctgacggggagccagcctcagggagccccaaaggaggtacccccaaatctcaggcgcctctagacctcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatggaggcagtcagcctcccagccaggccctaagagccaaaccatgggctggtcccacttggagcctgtggccaggaccacctcagcccctgggcctgcactgcctgcaggtgtggcccccttggcctggacctggggcctgaattgtgggaagggtggtttctttctttccttttttttcttttcttttttttttttttttttgtgcttcggagacatcagaattaataacactatttttgattttgaaaaaaaa

SEQ ID NO: 737287 - DNA, 1542 bp, Homo sapiens
ttttttttttaatttaatcagtaactttattataacaaaacctgtatattacccatttaaactcatgtgtaacattcagtgatgtgagctgtattaaacccaggtattagtgaaaatttgcattgtaaaacctggtaacagtagtcatcaaggtgaaccgggagtgcgtgcgcggcctgtgggccgggcagcagcaggagctggtgttcctgcgcaaccgcaaccccgagcgtggcagcatccagaacgccaagcaggcgcttcgcaacatgatcaactcctcctgtgaccagccgctgggctaccccatctacgtgtcgcctctcaccacctcgctggctggcagccacccccagctacgggcactgtggggtggccccatcagcctgggtgccattgcccactggctcctgcgcacctgggagaggcttcacaagggctgtggcgccggctgcaatagtggcgggaacgtggatgattcagactgtagtgggggcggtggcctgacctccctcagcaataacccccccgtggcacaccccacacctgagaacacggcaggcaatggtgaccaacccctcccaccaggccctggctgggggccgcggtcctccctgagtggctctggtgatgggcggcccccacctctgctgcagtggcctccccctcggctccctggaccaccccctgcatcgcctatccccacagagggtccccggacctcacggccccctggcccgggtctcctcagttctgagggccccagtggaaagtggagcctggggggccggaaggggctgggaggatctgacggggagccagcctcagggagccccaaaggaggtacccccaaatctcaggcgcctctagacctcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatggaggcagtcagcctcccagccaggccctaagagccaaaccatgggctggtcccacttggagcctgtggccaggaccacctcagcccctgggcctgcactgcctgcaggtgtggcccccttggcctggacctggggcctgaattgtgggaagggtggtttctttctttccttttttttcttttcttttttttttttttttttgtgcttcggagacatcagaattaataacactatttttgattttgaaaaaaaa

SEQ ID NO: 737288 - DNA, 1351 bp, Homo sapiens
ggcggtggacccaaaaagtgtaggcatgagacggtcagagctctttggggtcctgctcagagtcccccaggcagggcagagtctgtatcctgctgccatcttgcaagggaaaaccgcctctccttccaagtattgggtcttggaaaggtgtgtgtttggtgaaagccacttaatggtggtggggtgcagcttttctctaagtgcagttactcactcaggacaaaggaggaaaaggaaggcagaggtcagccagggtagagggtgatgtctgttttccttgggaaacatctgctgatgaactgggtccagggccgtgctaggtctgggaacaatcctctccaggtcttcacacagagtatcaccaatccacaaacagacccgaagtgaactagtttactctgcctacctgtcctttcaatagagcagtctttcccgctcttctgttctgagaatgcacccggaatgggggaaacccagcaagcagcagagagaaaggctcttcccgggagacctgccgcctctagggtggtcagagaatagcagctgggattttggagagggagaggataggtaaagcagcgtattgaagcatttgcggaggggtgtattagtcctcccaccctgagcacaccaggacggggatgcatccttgccttgtgtgcttgtaaaggcttctttcccttggtatagcaacttcaactgcacctgaacctccaacctctgcccagcctctggtgcagggtggatagaggtctagccagcccttacttcctgaagagagctctgtgggaaactcgaggctacagtagcttcccggctcccagctcctaccctacccccaccaaagcagaaacgggagacggcaacgttctggctgccattagacttacgtctccctcccctacgtcccctagcttcccaagacaggaagaaatgtgcaaaaggcccctccggagaaaactattttgccgttcagctgttctttacagaggatgttattttagtgagacccaggtcctagaccttctgattcctatttatttttttaacagactagtctcaaagtacagcacaaaatctcttctctgccttctcttgtgatgttccagagagcatctgtggttgtgatttggaataagtcatatttatttggtttactgtgcctattcagatctctgtatgttgtgtgtgtttctgtgtcctggaattggatgcgtgggactcgttctgtccgcggagtgcactctttttttcagtgtggcccacatatcttgtaaatgtttgctgaagagttgtgtctatatatagagaaaatatatataaacagagaaatatgtgaatctgttttttt

SEQ ID NO: 737289 - DNA, 782 bp, Homo sapiens
ttctatggagaactggcatattgaagttccctgtctcaaaggcagtgattggcacatgtcatctccaaagaaaagatcagtgaaaatcgtgcaagaaacttgctttctctcttcttgtttgctgaactccctaagatgtggaatctgttttgtctatagagcatcttgcaggtagactgttctccaaataacatttgagaaatgctggcttaaattattcttgggttttcattagtaagtagaagtaccataaagtatctaaaactccagtggtgattactggaatgggtgaagagtgaatagggcagggtggtgaagtaggaggaagacaatccttggcattagactctcctggctcctcacttcttagccgagcatcctttggaggttacttcatttctctaaaggtggctttctcaactgcaaaatagcactgcttacgcctaccccgtgaggtgctgtagatcctcagcctgttgaagggttgatatgggcctggcacagagtgagccctgtggatgctctgtatccctgtctctcttcacctgcacatgtaggcttatccaaaatgaggactagaggtaataaaattgcaccatgttgggattcctgctcaatgagtaaattttagccgctcttgtcccaaaaacagcaaaatgggtaattatgtgagataatggatatgttaatttgctttttcatagtaactattttactatctatatgtatcccataacgtcatattgtgtaccttaatatacacaatacactttatttaaaaa

SEQ ID NO: 737290 - DNA, 254 bp, Homo sapiens
tatcctcttcattgtattccttctcatctatgtgacctccataatgggtaatagtggaataatcttactcatcaacacagattccagatttcaaacactcacgtacttttttctacaacatttggcttttgttgatatctgttacacttctgctatcactcccaagatgctccaaagcttcacagaagaaaagaatttgatgttatttcagggctgtgtgatacaattcttagtttatgcaacatttgcaacca

SEQ ID NO: 737291 - DNA, 131 bp, Homo sapiens
cagaaagcccagagtagtccctgaagaagctgaggggcgcatacctctggggtttgggttcccttcagggaagcgaagggagatgacctctttccaggctggggaccaagagggctccctagaagatatta

SEQ ID NO: 737292 - DNA, 557 bp, Homo sapiens
ccaattgtcttgctttggttacctgtatgaatgaagagcacaagttatcatttcttaagaagatatttaatagtgatgaattgatccatttcaggttgaggttattagaagaggcccagttgcaggacttggagaaggccttggttttggccaatccagaagtctccctttggcgtaagcagaaggagctgcagtacttacagggacatcttgtttcgtctgacctctcccctagggtgacagctgtttgtggtgtggtgctgcctgggcagctgccagcccctggagagctgggtggtaataggagttcttcacgtgaacaggagctggcccttaggtcttatgtgctggttgagtctgtctgcaaaagtcttcagaccctggctatggcggttgcttctcagaatgctgtgttgttggaaggaccaataggatgtggcaaaacttccttagttgaatatttagctgcagtgacaggtagaacaaagcctcctcagcttctcaaagtccagcttggagatcagactgacagtaagatgcttttggggatgtatcgc

SEQ ID NO: 737293 - DNA, 883 bp, Homo sapiens; identical to SEQ ID NO: 2992

SEQ ID NO: 737294 - DNA, 1887 bp, Homo sapiens
acccctgagggtgatgggagagacgccccaggggcccagaacccggttccggttctggcttgtgcatatgttgacacagggagcagcatgttggtgtgagtttaacaaatatgctttctcctccccagcattggaggggatgggaacttggagactcacaccacactgcccagtaagtagcagcccagagaggcaccatcactgtggccgtcctccctggggccagggccttcctgctggaggaggggaagaggaggttatctgcaagaagggaagtcagccagccctgaaaagccccagaactcctgtgtcccacccatgtccccaccctgcatgctcatctcagttactgtgagggtcctgcaggctctcacctgtgctcttctcctcctcctcctcctctaaagacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgactgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccaccctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcctgggtttgcctgcgtgaagcactcaccttccatctcttgtgcagcccaggtgtgggagctgccactttttgtggcctgcctccagcagggctgcccaagccacgaccaaccagagcccaaactgcctgccaccacgagcatatcctcaagtcaccaaacccactatttcaaaggcagaaaaaatgctggtcaccaggtggtggctggaattttggagctggctggttgccattcagtccaatccaacacatacctattaagcaactgttttgtatccaggacaatgcgaagcactgaggtgcctcctaggctgtgcatgt

SEQ ID NO: 737295 - DNA, 2318 bp, Homo sapiens
ttcctggtctctttctagaatctgtattctgcagccaactttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagcgttttgtgtaactgcgttctgaccctgcgggagaactcccaagagctagccaggctggaggccttcagccgagcctaccggagcagcatgcgcgagctggtggggtcaggccgctatgacacgcaggaggacttctctgtggtgctgcagcccttcttccagaacatccagctccctgtcctggcggatgggctcccagatacgtccttctttgccccagactgcatccacccaaatcagaaattccactcccagctggccagagccctttggaccaatatgcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgactgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccaccctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcctgggtttgcctgcgtgaagcactcaccttccatctcttgtgcagcccaggtgtgggagctgccactttttgtggcctgcctccagcagggctgcccaagccacgaccaaccagagcccaaactgcctgccaccacgagcatatcctcaagtcaccaaacccactatttcaaaggcagaaaaaatgctggtcaccaggtggtggctggaattttggagctggctggttgccattcagtccaatccaacacatacctattaagcaactgttttgtatccaggacaatgcgaagcactgaggtgcctcctaggctgtgcatgt

SEQ ID NO: 737296 - DNA, 2035 bp, Homo sapiens
ttcctggtctctttctagaatctgtattctgcagccaactttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgactgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccaccctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcctgggtttgcctgcgtgaagcactcaccttccatctcttgtgcagcccaggtgtgggagctgccactttttgtggcctgcctccagcagggctgcccaagccacgaccaaccagagcccaaactgcctgccaccacgagcatatcctcaagtcaccaaacccactatttcaaaggcagaaaaaatgctggtcaccaggtggtggctggaattttggagctggctggttgccattcagtccaatccaacacatacctattaagcaactgttttgtatccaggacaatgcgaagcactgaggtgcctcctaggctgtgcatgt

SEQ ID NO: 737297 - DNA, 496 bp, Homo sapiens
ttcctggtctctttctagaatctgtattctgcagccaactttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactgtgagtagtgagccatgaaccaggatgggcagctcagagtccagccaggccct

SEQ ID NO: 737298 - DNA, 2471 bp, Homo sapiens
ttcctggtctctttctagaatctgtattctgcagccaactttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagagcagcatgcgcgagctggtggggtcaggccgctatgacacgcaggaggacttctctgtggtgctgcagcccttcttccagaacatccagctccctgtcctggcggatgggctcccagatacgtccttctttgccccagactgcatccacccaaatcagaaattccactcccagctggccagagccctttggaccaatatgcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccagtaagtagcagcccagagaggcaccatcactgtggccgtcctccctggggccagggccttcctgctggaggaggggaagaggaggttatctgcaagaagggaagtcagccagccctgaaaagccccagaactcctgtgtcccacccatgtccccaccctgcatgctcatctcagttactgtgagggtcctgcaggctctcacctgtgctcttctcctcctcctcctcctctaaagacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgactgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccaccctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcctgggtttgcctgcgtgaagcactcaccttccatctcttgtgcagcccaggtgtgggagctgccactttttgtggcctgcctccagcagggctgcccaagccacgaccaaccagagcccaaactgcctgccaccacgagcatatcctcaagtcaccaaacccactatttcaaaggcagaaaaaatgctggtcaccaggtggtggctggaattttggagctggctggttgccattcagtccaatccaacacatacctattaagcaactgttttgtatccaggacaatgcgaagcactgaggtgcctcctaggctgtgcatgt

SEQ ID NO: 737299 - DNA, 2499 bp, Homo sapiens
gtcccctgtcttgatgggctgcatagagaggtgcccagagtcctggtcaacctcgtggacttcctgaaccccactatcatgcggcaggtgttcctgggaaacccagacaagtgcccagtgcagcaggccagcgttttgtgtaactgcgttctgaccctgcgggagaactcccaagagctagccaggctggaggccttcagccgagcctaccggagcagcatgcgcgagctggtggggtcaggccgctatgacacgcaggaggacttctctgtggtgctgcagcccttcttccagaacatccagctccctgtcctggcggatgggctcccagatacgtccttctttgccccagactgcatccacccaaatcagaaattccactcccagctggccagagccctttggaccaatatgcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccagtaagtagcagcccagagaggcaccatcactgtggccgtcctccctggggccagggccttcctgctggaggaggggaagaggaggttatctgcaagaagggaagtcagccagccctgaaaagccccagaactcctgtgtcccacccatgtccccaccctgcatgctcatctcagttactgtgagggtcctgcaggctctcacctgtgctcttctcctcctcctcctcctctaaagacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgactgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccaccctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcctgggtttgcctgcgtgaagcactcaccttccatctcttgtgcagcccaggtgtgggagctgccactttttgtggcctgcctccagcagggctgcccaagccacgaccaaccagagcccaaactgcctgccaccacgagcatatcctcaagtcaccaaacccactatttcaaaggcagaaaaaatgctggtcaccaggtggtggctggaattttggagctggctggttgccattcagtccaatccaacacatacctattaagcaactgttttgtatccaggacaatgcgaagcactgaggtgcctcctaggctgtgcatgt

SEQ ID NO: 737300 - DNA, 820 bp, Homo sapiens; identical to SEQ ID NO: 44448

SEQ ID NO: 737301 - DNA, 1039 bp, Homo sapiens
tcagggtcaccgaaaagacagtgataagtcccggagccgcaaagatgatgacagcttgtctgaggcctctcattcaaaaaagactgttaaaaaggtggtggtagtggaacaaaatggttcttttcaagtaaagattcccaaaaattttgtttgtgaacactgctttggagcctttcggagcagttaccacctaaagaggcacatccttattcacactggtgagaagccatttgaatgcgatatatgtgatatgcgtttcatccagaagtaccacctggaacgccacaagcgtgtgcacagtggtgaaaagccttaccagtgtgaacggtgtcatcaggtaaggctcatccctgctacaataccccacacacacttttccttccccaagaatcagggccaccctccactcctgcctgacaaaagagccaccagcgttactcgccataatagttaacacatcggggtgaagtgcatctgtctggccttatgcagctgatcatggggagcagcaattagaacattgtaataataataataatagcattccatatcacttactctatgccaggcactgtgagagcatactttacatagatgattttatttaatcctcacattgactccctaaggtagctgtattgtccttatttcacgtatgggaaaattgagattcagagaagttaagtttcccagggacaccgcagatcacgaacagagctgggattcagtccaacttcagagctaatgcactttggaggaagagatacaatctttgccctgggggtcagtatctgatctgatgagaatgtaagagctggggccaaaacaagacaagaacaagagatgagaaatgataatagctaacacttcctggatgcattgctaggtcccaagctttgctctgcactcttacactgaatcttcagacgctagaataaaagctccatgagggcagagactttgttcctctggttctctactctgtatctgccttgagatagatactcaataaatctttgatgaataaagcagctgtgct

SEQ ID NO: 737302 - DNA, 3707 bp, Homo sapiens
tcagggtcaccgaaaagacagtgataagtcccggagccgcaaagatgatgacagcttgtctgaggcctctcattcaaaaaagactgttaaaaaggtggtggtagtggaacaaaatggttcttttcaagtaaagattcccaaaaattttgtttgtgaacactgctttggagcctttcggagcagttaccacctaaagaggcacatccttattcacactggtgagaagccatttgaatgcgatatatgtgatatgcgtttcatccagaagtaccacctggaacgccacaagcgtgtgcacagtggtgaaaagccttaccagtgtgaacggtgtcatcagtgtttttctcggacagatcgattactcagacacaaacggatgtgccaagggtgccagtccaagacttccgacgggcagttttctctataggcgcaaggggccccgggtggtgggagtgatcagaagaacctgccgaagagcacaccccctctggtctgatggtcccaccaccgccccatgtgaacctgtcccactcctggaggagtggacccaggagaccagaagagtgcatcaggggacagtggccccagaacctcagctctgtaaataatctgagactatgagtatctcggggaagttcttacagcattcctgggtaggggagctagtccctggacccttggctgaggtcataggtggggactcaaggtacaggaccaagactgaagtgtggctcccacaaccttggactccagctggcagctgaaatggaaaagattggggaaggggatttgtttgttctgttcttgtttttgtttatccaaaagcaacttcagcgggtaaactgtggatacaggtaatccagaggcataagagtcctggtccaaagtagggactatagctggtccagctctccccaaaaattgggtttttagttgcagtagctcctcagtgtttcacaatcctgcacttcgcctcctttttgaggaagaataaggtcaggaatggcagctgagcttactttggcttccttatacactgtagggacaaaaggaaaaacggggtggagcagacaagggctggatccaaaaagtggatggcacctcttccttcctcaagggaaaaggaagagttgtgccagtgggtgttgtcatggcccatgtcacattggcacctgatggcatcagctcaaatgcctttaggaggaaacttgggtgagagtggcccatgaagcccttttcttctttttttggggagtcggtcttggagatggtatgtggctacctcgctgccattgactcctaaagtgagacagatgtgttgagcaaggagtcatggaagtcaaagtgggttctctctccttgtgccctcttaggaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaacaagatctcggcttgcttcctgatggccatccctacccaacagagtgtgggggatgggggtgggggtgctgcagagaaaagactaaagaagaaacctaatgtaggttccattcttaaccatattctttgctcctctctgctccaataccaccaccttgtccactcccaaaaaagtaatcgggtgtgtgtgtgtgtgtgagagagagtgtgtgtgagatatgaatgcatgtatttgtatgcttgcaggagatggcatattattgagccaaacccttctctggccctcaccttcagggaggatgagtggaaaatagcctcctcttgcccaaacatgaagggtgcttgaggtctcagcaggagctgaagaacacaatttggggaacagaagggcttttgttttggagggtttttttttttaagatgaattcaacagcctggtggttaggatgtttctaacccaagccagggcttgtgaacatgaattttctaaggtgaaataaaccttttctttctgctaaagaaagaatccttatgggaagttttggggtttggttgacccccactgtaacctgacctgacctgtggcgggtacgggaactgtcttagtaatcatggagactggctgaacctgagtgccaagctgtcagtagggtctgagatgggaaactcctgaaagtatgatttcatttcccagaaaatgtaaagaatggataccagcaatgattcctggctgttacctattctggaggggtggggttggggagggggttgtccatacctctgtggtatgagtatttcagggaaaaagaaagcaggcatggcacccattcgattttccctgacagcatctgagatccttttggggagacgctgaggagtgtttgctgccatgtactcttacagctctatgctgacactcccatttgatgtggtccagaacttagacctcagtccttggatcagccctgtggtccctgcaagcaggggcatctttctgcatgtgagccagcccccttcctgttcaagggttctgctggatctgggcttttcctgtccttcacttctgggatgattcaccccacatcttccagtaccctgtaaaccattttaaaatatttagaaaactatcctcccaaaaatgcttttgaaaatgagagccctctgtccctgccacttacagctagtctctttgggataggggtgtatgtggagagattcatgtaagtctcacatgagtgacctgtgcccctatgtgtactaatgtgtgtactgggtcagaaggtgccctgggttcccacagaccttggtttcctgcctgggtgggtgggagggagggaacttcagagagtatgtgcgaacagccatagcagagccacccctgccaaggacccagtgagggaaactcaggagcaggtggttggttcagttcccgcgctgatgtctggggcagtgcatgtgtgagaagagaggcgcaaagcagtgaaaggagtgatttggcatccagagggcccgggagccccacggataccccagggaagccactgactcacaccgctgcagaggctcctgggcccaatgcccgacccctgctggccagcatggggcctagcactggaagatgcctcaggtgtgtttggagtgggggaaacggaagtagggcacgctctcagagaccaggatagagagtcagggaacctgggaaagagtagtgccagttccgggtaggctgctgcaccaggccctaccagctcaggctataaacagtctgctttgccccaagtcttttccgtccacccccaacagccttgtcatcacttagctactgatcacgcccatggcttgacattggagggttacattagtggagtccgccacagcttcgaaccctctccccagatgccctttgcctctgctgtggccctggggttttatcaactgtccccttcctatcctcctctccaccctgttttttgttttttttttttttaaataatattttgctatgggggaggggaatatcaaatggacaagatcacttttaaatggtagtttttataagatgttataaacttgtatctttttaccattaaagtgcagtgtatgttccttcgtgatatatttaggatatttaaataaaaggaaaatggggcttttctacatacta

SEQ ID NO: 737303 - DNA, 2772 bp, Homo sapiens
tcagggtcaccgaaaagacagtgataagtcccggagccgcaaagatgatgacagcttgtctgaggcctctcattcaaaaaagactgttaaaaaggtggtggtagtggaacaaaatggttcttttcaagtaaagattcccaaaaattttgtttgtgaacactgctttggagcctttcggagcagttaccacctaaagaggcacatccttattcacactggtgagaagccatttgaatgcgatatatgtgatatgcgtttcatccagaagtaccacctggaacgccacaagcgtgtgcacagtggtgaaaagccttaccagtgtgaacggtgtcatcagtgtttttctcggacagatcgattactcagacacaaacggatgtgccaagggtgccagtccaagacttccgacgggcagttttctctataggcgcaaggggccccgggtggtgggagtgatcagaagaacctgccgaagagcacaccccctctggtctgatggtcccaccaccgccccatgtgaacctgtcccactcctggaggagtggacccaggagaccagaagagtgcatcaggggacagtggccccagaacctcagctctgtaaataatctgagactatgagtatctcggggaagttcttacagcattcctgggtaggggagctagtccctggacccttggctgaggtcataggtggggactcaaggtacaggaccaagactgaagtgtggctcccacaaccttggactccagctggcagctgaaatggaaaagattggggaaggggatttgtttgttctgttcttgtttttgtttatccaaaagcaacttcagcgggtaaactgtggatacaggtaatccagaggcataagagtcctggtccaaagtagggactatagctggtccagctctccccaaaaattgggtttttagttgcagtagctcctcagtgtttcacaatcctgcacttcgcctcctttttgaggaagaataaggtcaggaatggcagctgagcttactttggcttccttatacactgtagggacaaaaggaaaaacggggtggagcagacaagggctggatccaaaaagtggatggcacctcttccttcctcaagggaaaaggaagagttgtgccagtgggtgttgtcatggcccatgtcacattggcacctgatggcatcagctcaaatgcctttaggaggaaacttgggtgagagtggcccatgaagcccttttcttctttttttggggagtcggtcttggagatggtatgtggctacctcgctgccattgactcctaaagtgagacagatgtgttgagcaaggagtcatggaagtcaaagtgggttctctctccttgtgccctcttaggaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaacaagatctcggcttgcttcctgatggccatccctacccaacagagtgtgggggatgggggtgggggtgctgcagagaaaagactaaagaagaaacctaatgtaggttccattcttaaccatattctttgctcctctctgctccaataccaccaccttgtccactcccaaaaaagtaatcgggtgtgtgtgtgtgtgtgagagagagtgtgtgtgagatatgaatgcatgtatttgtatgcttgcaggagatggcatattattgagccaaacccttctctggccctcaccttcagggaggatgagtggaaaatagcctcctcttgcccaaacatgaagggtgcttgaggtctcagcaggagctgaagaacacaatttggggaacagaagggcttttgttttggagggtttttttttttaagatgaattcaacagcctggtggttaggatgtttctaacccaagccagggcttgtgaacatgaattttctaaggtgaaataaaccttttctttctgctaaagaaagaatccttatgggaagttttggggtttggttgacccccactgtaacctgacctgacctgtggcgggtacgggaactgtcttagtaatcatggagactggctgaacctgagtgccaagctgtcagtagggtctgagatgggaaactcctgaaagtatgatttcatttcccagaaaatgtaaagaatggataccagcaatgattcctggctgttacctattctggaggggtggggttggggagggggttgtccatacctctgtggtatgagtatttcagggaaaaagaaagcaggcatggcacccattcgattttccctgacagcatctgagatccttttggggagacgctgaggagtgtttgctgccatgtactcttacagctctatgctgacactcccatttgatgtggtccagaacttagacctcagtccttggatcagcccctttgcctctgctgtggccctggggttttatcaactgtccccttcctatcctcctctccaccctgttttttgttttttttttttttaaataatattttgctatgggggaggggaatatcaaatggacaagatcacttttaaatggtagtttttataagatgttataaacttgtatctttttaccattaaagtgcagtgtatgttccttcgtgatatatttaggatatttaaataaaaggaaaatggggcttttctacatacta

SEQ ID NO: 737304 - DNA, 1595 bp, Homo sapiens
tcagggtcaccgaaaagacagtgataagtcccggagccgcaaagatgatgacagcttgtctgaggcctctcattcaaaaaagactgttaaaaaggtggtggtagtggaacaaaatggttcttttcaagtaaagattcccaaaaattttgtttgtgaacactgctttggagcctttcggagcagttaccacctaaagaggcacatccttattcacactggtgagaagccatttgaatgcgatatatgtgatatgcgtttcatccagaagtaccacctggaacgccacaagcgtgtgcacagtggtgaaaagccttaccagtgtgaacggtgtcatcagtgtttttctcggacagatcgattactcagacacaaacggatgtgccaagggtgccagtccaagacttccgacgggcagttttctctataggcgcaaggggccccgggtggtgggagtgatcagaagaacctgccgaagagcacaccccctctggtctgatggtcccaccaccgccccatgtgaacctgtcccactcctggaggagtggacccaggagaccagaagagtgcatcaggggacagtggccccagaacctcagctctgtaaataatctgagactatgagtatctcggggaagttcttacagcattcctgggtaggggagctagtccctggacccttggctgaggtcataggtggggactcaaggtacaggaccaagactgaagtgtggctcccacaaccttggactccagctggcagctgaaatggaaaagattggggaaggggatttgtttgttctgttcttgtttttgtttatccaaaagcaacttcagcgggtaaactgtggatacaggtaatccagaggcataagagtcctggtccaaagtagggactatagctggtccagctctccccaaaaattgggtttttagttgcagtagctcctcagtgtttcacaatcctgcacttcgcctcctttttgaggaagaataaggtcaggaatggcagctgagcttactttggcttccttatacactgtagggacaaaaggaaaaacggggtggagcagacaagggctggatccaaaaagtggatggcacctcttccttcctcaagggaaaaggaagagttgtgccagtgggtgttgtcatggcccatgtcacattggcacctgatggcatcagctcaaatgcctttaggaggaaacttgggtgagagtggcccatgaagcccttttcttctttttttggggagtcggtcttggagatggtatgtggctacctcgctgccattgactcctaaagtgagacagatgtgttgagcaaggagtcatggaagtcaaagtgggttctctctccttgtgccctcttaggaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaacaagatctcggcttgcttcctttattggacgttttttccaaaaatacatgtt

SEQ ID NO: 737305 - DNA, 2934 bp, Homo sapiens
tcagggtcaccgaaaagacagtgataagtcccggagccgcaaagatgatgacagcttgtctgaggcctctcattcaaaaaagactgttaaaaaggtggtggtagtggaacaaaatggttcttttcaagtaaagattcccaaaaattttgtttgtgaacactgctttggagcctttcggagcagttaccacctaaagaggcacatccttattcacactggtgagaagccatttgaatgcgatatatgtgatatgcgtttcatccagaagtaccacctggaacgccacaagcgtgtgcacagtggtgaaaagccttaccagtgtgaacggtgtcatcagtgtttttctcggacagatcgattactcagacacaaacggatgtgccaagggtgccagtccaagacttccgacgggcagttttctctataggcgcaaggggccccgggtggtgggagtgatcagaagaacctgccgaagagcacaccccctctggtctgatggtcccaccaccgccccatgtgaacctgtcccactcctggaggagtggacccaggagaccagaagagtgcatcaggggacagtggccccagaacctcagctctgaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaacaagatctcggcttgcttcctgatggccatccctacccaacagagtgtgggggatgggggtgggggtgctgcagagaaaagactaaagaagaaacctaatgtaggttccattcttaaccatattctttgctcctctctgctccaataccaccaccttgtccactcccaaaaaagtaatcgggtgtgtgtgtgtgtgtgagagagagtgtgtgtgagatatgaatgcatgtatttgtatgcttgcaggagatggcatattattgagccaaacccttctctggccctcaccttcagggaggatgagtggaaaatagcctcctcttgcccaaacatgaagggtgcttgaggtctcagcaggagctgaagaacacaatttggggaacagaagggcttttgttttggagggtttttttttttaagatgaattcaacagcctggtggttaggatgtttctaacccaagccagggcttgtgaacatgaattttctaaggtgaaataaaccttttctttctgctaaagaaagaatccttatgggaagttttggggtttggttgacccccactgtaacctgacctgacctgtggcgggtacgggaactgtcttagtaatcatggagactggctgaacctgagtgccaagctgtcagtagggtctgagatgggaaactcctgaaagtatgatttcatttcccagaaaatgtaaagaatggataccagcaatgattcctggctgttacctattctggaggggtggggttggggagggggttgtccatacctctgtggtatgagtatttcagggaaaaagaaagcaggcatggcacccattcgattttccctgacagcatctgagatccttttggggagacgctgaggagtgtttgctgccatgtactcttacagctctatgctgacactcccatttgatgtggtccagaacttagacctcagtccttggatcagccctgtggtccctgcaagcaggggcatctttctgcatgtgagccagcccccttcctgttcaagggttctgctggatctgggcttttcctgtccttcacttctgggatgattcaccccacatcttccagtaccctgtaaaccattttaaaatatttagaaaactatcctcccaaaaatgcttttgaaaatgagagccctctgtccctgccacttacagctagtctctttgggataggggtgtatgtggagagattcatgtaagtctcacatgagtgacctgtgcccctatgtgtactaatgtgtgtactgggtcagaaggtgccctgggttcccacagaccttggtttcctgcctgggtgggtgggagggagggaacttcagagagtatgtgcgaacagccatagcagagccacccctgccaaggacccagtgagggaaactcaggagcaggtggttggttcagttcccgcgctgatgtctggggcagtgcatgtgtgagaagagaggcgcaaagcagtgaaaggagtgatttggcatccagagggcccgggagccccacggataccccagggaagccactgactcacaccgctgcagaggctcctgggcccaatgcccgacccctgctggccagcatggggcctagcactggaagatgcctcaggtgtgtttggagtgggggaaacggaagtagggcacgctctcagagaccaggatagagagtcagggaacctgggaaagagtagtgccagttccgggtaggctgctgcaccaggccctaccagctcaggctataaacagtctgctttgccccaagtcttttccgtccacccccaacagccttgtcatcacttagctactgatcacgcccatggcttgacattggagggttacattagtggagtccgccacagcttcgaaccctctccccagatgccctttgcctctgctgtggccctggggttttatcaactgtccccttcctatcctcctctccaccctgttttttgttttttttttttttaaataatattttgctatgggggaggggaatatcaaatggacaagatcacttttaaatggtagtttttataagatgttataaacttgtatctttttaccattaaagtgcagtgtatgttccttcgtgatatatttaggatatttaaataaaaggaaaatggggcttttctacatacta

SEQ ID NO: 737306 - DNA, 1424 bp, Homo sapiens
  misc_feature (1424)..(1424): n is a, c, g, or t
cacacactgagccctgtgctctttcctctgcccaaatggcccttccctcagacatctagatgtccatcctccttccctcagtctgcctctcggagcagtcttcccgaccactacaacgatgcctccccaaccccggcctgcgtcactccccacgcccaccctgctttgcagcatcgctccctggctgacattacatcatgcatttatttctttgcttattgtctccctcccctccatgagggcaggaaccttcatctgtcttgttgacagtagcatccctagaacctagctcaggcctgactcacagtgtgtgctcagtccacatttgggaaaccaatggagagatgaatggcacagagatgcgctcaggaacccagttccctgacctcccatccaggctgcacccctcaggagtctaggttcctgctgattggtagagttcaggacccagggctggaaagtgtccacccacagggcagatgggccaaggccacgtgctcaaggtgtgcagggctaggagagggggtcagccccagctcccatatgaggggcatgtgcctcgccttgcccctgctttggctagagggtaccctgttcaccagagatgagcccaggctctccccgggcccggctctggctttaccccagagccctccaactcgcagacctccaggcaaggagggctggggacccacccgtaccagccatttgccttttctccagtaacagagcccagaggggtccctgcctgggcccaaaatcacacagcagattggggtagagccggagaggacccgagactcctgtgccagcctgggcatcccctccactgccagggaaggactgcatccaagtcgcatccgtacccaggccgaggtgtccgaggcccaggctgaaatccggttgctgctgcagagaccaagtttccaaggccttgtcaagtgggctgtgccagacgatccccaggcctgtcattggctgctcttcggctcggacacaccaaacctcaccaagcacttccatttcagctgggagactccgggaacctccaaccctgctgagcctccacttcgacatccgtgaaacagccatgaataagcaggtctcaaaggtcgactcctgtatgcagggacacagcatgcagtaggtgcccaatcataacagcagcacccacctggagccccttatagcagcccttctcctctgcacttccacatggcatctcatttaaccttcaccacaacccaactaggaaggcaccatcattatcccattttactgatgaagaaactgaggcccaggaaggtgaatttaccagccagctcacaaatggactagtagatggcagtttgtggattggagcccagaggctgtgctcctgcccacaccctctcaaatgagggctataaaataacactctaagn

SEQ ID NO: 737307 - DNA, 795 bp, Homo sapiens
cacacactgagccctgtgctctttcctctgcccaaatggcccttccctcagacatctagatgtccatcctccttccctcagtctgcctctcggagcagtcttcccgaccactacaacgatgcctccccaaccccggcctgcgtcactccccacgcccaccctgctttgcagcatcgctccctggctgacattacatcatgcatttatttctttgcttattgtctccctcccctccatgagggcaggaaccttcatctgtcttgttgacagtagcatccctagaacctagctcaggcctgactcacagtgtgtgctcagtccacatttgggaaaccaatggagagatgaatggcacagagatgcgctcaggaacccagttccctgacctcccatccaggctgcacccctcaggagtctaggttcctgctgattggtagagttcaggacccagggctggaaagtgtccacccacagggcagatgggccaaggccacgtgctcaaggtgtgcagggctaggagagggggtcagccccagctcccatatgaggggcatgtgcctcgccttgcccctgctttggctagagggtaccctgttcaccagagatgagcccaggctctccccgggcccggctctggctttaccccagagccctccaactcgcagacctccaggcaaggagggctggggacccacccggtggaaggatctgttaagcccaggaagttgaggctgcagtgagttatcatcccaccactgcacttcagcctgggcaatggagcaacaccctgtctca

SEQ ID NO: 737308 - DNA, 542 bp, Homo sapiens
cagtgcgagcccctggcagaccagggccaggtcttgtttatttctgtatccctggtttccagggaggtggctggcatgggggtggctggcatgggggtggggtggagatcaagaaatgtgggagaggaaggaagagtatgagtggaaagctctaaactcagccttaagggcaggccaaggccaagtccctccggactctaaagggctcccagagaaagcaaacctcctacagtacgccagacctcctgccgcgcctgagcccgccagtccaatgaagaggccagagccctcgctgctggcgaagagggaggctccaatcggccaccacgtcatgtcccggcctgccaggaagtagccattcaccgtgttcctactggcccgacaagaggaccatatgcccacggccacattcagagcaaaatacacagtgatgacgatgatgtcagccacgctcagctgcgtcccgggagtgtggaggtcgctggtggagttggcggccatggctgtcctgccgcaggcactaggtatgagcccgagggact

SEQ ID NO: 737309 - DNA, 671 bp, Homo sapiens
cagtgcgagcccctggcagaccagggccaggtcttgtttatttctgtatccctggtttccagggaggtggctggcatgggggtggctggcatgggggtggggtggagatcaagaaatgtgggagaggaaggaagagtatgagtggaaagctctaaactcagccttaagggcaggccaaggccaagtccctccggactctaaagggctcccagagaaagcaaacctcctacagtacgccaagggcatctggcgaagactgcggtactcaggtaaggtgacgatctctgaggagatgtagatgggcacgaacacccatgccagtgccagcagcacgtacgtggcattccactcgaagcctgccacggccagacctcctgccgcgcctgagcccgccagtccaatgaagaggccagagccctcgctgctggcgaagagggaggctccaatcggccaccacgtcatgtcccggcctgccaggaagtagccattcaccgtgttcctactggcccgacaagaggaccatatgcccacggccacattcagagcaaaatacacagtgatgacgatgatgtcagccacgctcagctgcgtcccgggagtgtggaggtcgctggtggagttggcggccatggctgtcctgccgcaggcactaggtatgagcccgagggact

SEQ ID NO: 737310 - DNA, 456 bp, Homo sapiens
cagtgcgagcccctggcagaccagggccaggtcttgtttatttctgtatccctggtttccagggaggtggctggcatgggggtggctggcatgggggtggggtggagatcaagaaatgtgggagaggaaggaagagtatgagtggaaagctctaaactcagccttaagggcaggccaaggccaagtccctccggactctaaagggctcccagagaaagcaaacctcctacagtacgccaagggcatctggcgaagactgcggtacggggtttgctgctggccactcctgagacctgcccacacgaaggatgagacactctgggaatcccctcagagtcacctagcaacaccagtgcagatagaggccaggctgaggctgccgaggggatgccccaggagaggagagggcgggtcagatgctgcatgagacccccaccggggccccgtgggggctct

SEQ ID NO: 737311 - DNA, 584 bp, Homo sapiens
attatgtgaattatatatctcctgcaaatatcgaatacttgagtcatgtgttaaactcgatgcttcatatttcataatctcttctaacattctcctggacttcaaagtagcagcgtctatcatatttggttttgatgattcatcaggattataagtgagttggattgcttttatcagctgtttgacttctgatgttttgttttcaacttgatgtaagatgtcttccaaagactgtagatccttgtctactttggtttgataagtagacaggaaatctgcaatgccacaggtagttggacaataactaccgaatctttcatctaagatgcagcagttgtctctggtagcaacatatgctacacatgttgaagagagaaataaaagagcatagaagtagagaattaaattccgggggtgcaaggaccaactcatgatgtctgagtgcccggagctccgagccttgcggggccattgtgaggttgggggaagacctggccgtggagctacaagcttgtgcggatgtcaggggacattactgttgctaataaagtccaaagtggccaatgcctttcccaaaaaaaaaa

SEQ ID NO: 737312 - DNA, 699 bp, Homo sapiens
gaacttagggaagttgctcgctgtgtgaccttggggaagttgctgcacctctccagggtcacacagcgaggaacttagagctggtgcccaccgacctctgtgccctgacagacctggtctgtcctccacccaccctccctgagctccaaagacccagcaggagtctgtctgcaccagtgtcctgcccctcccaagctcagcttgactctggttcctgtctgctgccgaacaggttgttccacccctccttttcacagatgggcaaactgaggccagagaggggccatgcctgatggagatcgcccagcgggcagttagcacccaggtgggtccacacgtccacaagccctggttggggtggtggagggggtgtcctagggctcctgcccccaccccagccttgtttttcctctctgggctgacactgttacctttgctgctgctgctgctgctgctgctgctgctgctgccgccaccaggccagaaaaactcgctgggcaggactggctgctgccagcattaggcctgacttggtccttggggcttttctgacagcccaggggtcagcctagccccttgttcccctgggtaggtggatgtaggggtcacacagagagacaaagatactcatgattgctcagtgagagactcacacataacagtcactccacacagtgggagacacacacagacacacac

SEQ ID NO: 737313 - DNA, 5697 bp, Homo sapiens
  misc_feature (2195)..(2195): n is a, c, g, or t
  misc_feature (2578)..(2578): n is a, c, g, or t
gtctcagaccaaaggcccccttatctgctccccagagcctgacgtccccccactgaattgtcacccctgagctgtctaaatgcgagggaccctaggtgaccactggtggctgtgctcaggccgggtcccccgaccttcaccccaaggctcagtgcgtggcatatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaactatggagaccaggtgcagcacttcaaggtgctgcgtgaggcctcggggaagtacttcctgtgggaggagaagttcaactccctcaacgagctggtcgacttctaccgcaccaccaccatcgccaagaagcggcagatcttcctgcgcgacgaggagcccttgctcaagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgactttcagctccccctggggcacccagcaccccaccacagggctagaaggccctaagacccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaatctaattttccttccaatgctgactgctttggtgctgtttttgaaatgtcacattattttctcccatttcccccctaatttttcagggctcccgctttgctggcttggccagttcttgggcaccgagctgctgtgcagctgtgaggggaatctgcccctcttggggcntcgggatccccatgagggaaatgggtggacctgaggactcagagctcctgcctttctgtccaggatggcagtgtcaggcgaagtaggcataaaagaatatgttgacacacatgaggaggatggcattgaagccacagacacgggcccagaaggcgtgtttctggggtgtttggccatcacctgctttagttcccaagggcacatcctgagccagggtccaccaggtaaggttctcaatctggacactctgtgggggtggggtcagcaggcttccagccaccacaacagcaccactgagtgcaaagagggcgacagcgaagtgcaggtagtggatgctccccaggacggctggccgcgtgtctggctctccgcacggtggggcngggttcaggaattccaggaccagcctcgtggcccccaccaccagccctgctatcaggccccagaaggccccctgctcgttggcacgtcgccagaagacgcccaggacaaagactgcagtcactggtggggccagggagctggtcactgactgcatgtagatgaagagttgcccgctgttggagtcctgcaggacggggatccaggccacactcacgccgatgagtgccactatgaccagccgtcccaccagcaggagctcccgctcgccggagcggggacgcagccgcctccagatgtccatagtgaagagggtgctgctgctgttgaagatggaggtcagcgacgacatgagcgccgccagcatcactgcgatcatcagcccccgcagaccgatgggcatcagttccatgaccagcttggggtaggcgatgttggagcagccgacctcggccccgcaggcccgcaggcactcggacggcaccacgcagcccacatcatctgttcgagagacggacacttggtgtctctcctcatagacatgagcacctgggaacaatgcgcggctgatcatgcccggcatgatgatcaggcccatggggagcatcttgaggtagctggccaggatggagcccgccttggcatggttcaggtcccgggctgacagtgatcgctgcacgatgacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctggaggggtcagggtggaacagggacagtttggtggttgcggggccctgactccctgggctcccccctgccttcatctcacaagaaacttcctgatgcatcaaacttgagttttttccacctcatctttcccagtgtttggaaaggtgtgagggtagagggttgtttttttttttaaggtgtatttgaatgactattttattcgtatttaaaataatactattaagtaagcattttgcacatgggcaccccagtgtcccgctggcccagcaggagtcactgttggcctctggacactcatcggccttgggcaagtggttctcagccaggtttccgattgtcgattcaaggaagcaaaagtaatttttcttgacatttgaggaccttcctgaggcttctaaagtgttcatcctgatcacctgaagggtgtgattttagcagagctgagagtggctggtggtgatgtggccccaccccctgaggcacagagaagagggagacaggtccagagagggatggggcctccaccaagaccatatagaccatctggcgggctcaagccggggctttttcctctccagtccaaaacacctcactgttcctgtctacctcggggtcagggcccggcatggccaagccctggcccatctgtgtctgtgtcactcccctcccttccagactgggcctggctgctgggatccctctcatgcggtgggtcccagggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcagagcaaatgaacaagtgccattcaagggttagaaactgctcagccacagggtcccagtgtctgagtctggaagagtctttagagatttgttcactctctgagggatcctcctggctctgcttacatacttccagggacggtgagctcacgctctctccgggcagccctgtgagtttcctatctgttccagactagtatcgccaatctctcccagctctcttctttcctccctggcctttgtcctgcaggaggtagcatcacctcttggcattttgtacatgcttttaaacaattggaggagctgcccaggcagttttatggcctcctggttgtgtgccttcacacccgcctacagccccacctcaccatcaagcgctgagccaatgcgggtgtggctggccctgagttcctgagtcagctccttgccagggccagagctggtaacagcggggcagcagggtgggtagcctctaccagccagggcagtccctgaggggccagcaggggggctgactgcctagtggctcaacctcctgaacccacccactcccagcgatgctacccagaaccccaacggcatgaatcctgcacagtgccgggcagtgccagactccaaagggctcgctgtggggacagccccgccatggccacagactctgtcctcacctttgattgtcaggatgacagcccccaccaccatgatgagcgtctgcagggcgtccgtgtagattacagcagccaggccccctgccagtggaagcaaggttgctggagggggccctggccccagggaggagggacacggggaggaacttctggggctcctgctggggccacttcctgggctgctccctcgggcctgtagggggaggtggccttctgacccctttacacgtcccctgggtggacctccctgctgcaggcaccatacctgcgatggtgtacagggctgtgatgccgagcgtgaggatggtggagaggtagaagttccagcccaggcagatgtgcacaaacagagcccccgcgtacaggtccagctgcggagggagagagccttgtgtgggactgttattcccagggctccagcaagccactccctgggtgacctcgggcaaggccctctctgggcctcggtggcctgtggataaggaggggagacccccactcgcctgcctgcctgcatcacggggccattgtgaggttgggggaagacctggccgtggagctacaagcttgtgcggatgtcaggggacattactgttgctaataaagtccaaagtggccaatgcctttcccaaaaaaaaaa

SEQ ID NO: 737314 - DNA, 5565 bp, Homo sapiens
  misc_feature (2195)..(2195): n is a, c, g, or t
  misc_feature (2578)..(2578): n is a, c, g, or t
gtctcagaccaaaggcccccttatctgctccccagagcctgacgtccccccactgaattgtcacccctgagctgtctaaatgcgagggaccctaggtgaccactggtggctgtgctcaggccgggtcccccgaccttcaccccaaggctcagtgcgtggcatatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaactatggagaccaggtgcagcacttcaaggtgctgcgtgaggcctcggggaagtacttcctgtgggaggagaagttcaactccctcaacgagctggtcgacttctaccgcaccaccaccatcgccaagaagcggcagatcttcctgcgcgacgaggagcccttgctcaagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgactttcagctccccctggggcacccagcaccccaccacagggctagaaggccctaagacccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaatctaattttccttccaatgctgactgctttggtgctgtttttgaaatgtcacattattttctcccatttcccccctaatttttcagggctcccgctttgctggcttggccagttcttgggcaccgagctgctgtgcagctgtgaggggaatctgcccctcttggggcntcgggatccccatgagggaaatgggtggacctgaggactcagagctcctgcctttctgtccaggatggcagtgtcaggcgaagtaggcataaaagaatatgttgacacacatgaggaggatggcattgaagccacagacacgggcccagaaggcgtgtttctggggtgtttggccatcacctgctttagttcccaagggcacatcctgagccagggtccaccaggtaaggttctcaatctggacactctgtgggggtggggtcagcaggcttccagccaccacaacagcaccactgagtgcaaagagggcgacagcgaagtgcaggtagtggatgctccccaggacggctggccgcgtgtctggctctccgcacggtggggcngggttcaggaattccaggaccagcctcgtggcccccaccaccagccctgctatcaggccccagaaggccccctgctcgttggcacgtcgccagaagacgcccaggacaaagactgcagtcactggtggggccagggagctggtcactgactgcatgtagatgaagagttgcccgctgttggagtcctgcaggacggggatccaggccacactcacgccgatgagtgccactatgaccagccgtcccaccagcaggagctcccgctcgccggagcggggacgcagccgcctccagatgtccatagtgaagagggtgctgctgctgttgaagatggaggtcagcgacgacatgagcgccgccagcatcactgcgatcatcagcccccgcagaccgatgggcatcagttccatgaccagcttggggtaggcgatgttggagcagccgacctcggccccgcaggcccgcaggcactcggacggcaccacgcagcccacatcatctgttcgagagacggacacttggtgtctctcctcatagacatgagcacctgggaacaatgcgcggctgatcatgcccggcatgatgatcaggcccatggggagcatcttgaggtagctggccaggatggagcccgccttggcatggttcaggtcccgggctgacagtgatcgctgcacgatgacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctggaggggtcagggtggaacagggacagtttggtggttgcggggccctgactccctgggctcccccctgccttcatctcacaagaaacttcctgatgcatcaaacttgagttttttccacctcatctttcccagtgtttggaaaggtgtgagggtagagggttgtttttttttttaaggtgtatttgaatgactattttattcgtatttaaaataatactattaagtaagcattttgcacatgggcaccccagtgtcccgctggcccagcaggagtcactgttggcctctggacactcatcggccttgggcaagtggttctcagccaggtttccgattgtcgattcaaggaagcaaaagtaatttttcttgacatttgaggaccttcctgaggcttctaaagtgttcatcctgatcacctgaagggtgtgattttagcagagctgagagtggctggtggtgatgtggccccaccccctgaggcacagagaagagggagacaggtccagagagggatggggcctccaccaagaccatatagaccatctggcgggctcaagccggggctttttcctctccagtccaaaacacctcactgttcctgtctacctcggggtcagggcccggcatggccaagccctggcccatctgtgtctgtgtcactcccctcccttccagactgggcctggctgctgggatccctctcatgcggtgggtcccagggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcagagcaaatgaacaagtgccattcaagggttagaaactgctcagccacagggtcccagtgtctgagtctggaagagtctttagagatttgttcactctctgagggatcctcctggctctgcttacatacttccagggacggtgagctcacgctctctccgggcagccctgtgagtttcctatctgttccagactagtatcgccaatctctcccagctctcttctttcctccctggcctttgtcctgcaggaggtagcatcacctcttggcattttgtacatgcttttaaacaattggaggagctgcccaggcagttttatggcctcctggttgtgtgccttcacacccgcctacagccccacctcaccatcaagcgctgagccaatgcgggtgtggctggccctgagttcctgagtcagctccttgccagggccagagctggtaacagcggggcagcagggtgggtagcctctaccagccagggcagtccctgaggggccagcaggggggctgactgcctagtggctcaacctcctgaacccacccactcccagcgatgctacccagaaccccaacggcatgaatcctgcacagtgccgggcagtgccagactccaaagggctcgctgtggggacagccccgccatggccacagactctgtcctcacctttgattgtcaggatgacagcccccaccaccatgatgagcgtctgcagggcgtccgtgtagattacagcagccaggccccctgccagtggaagcaaggttgctggagggggccctggccccagggaggagggacacggggaggaacttctggggctcctgctggggccacttcctgggctgctccctcgggcctgtagggggaggtggccttctgacccctttacacgtcccctgggtggacctccctgctgcaggcaccatacctgcgatggtgtacagggctgtgatgccgagcgtgaggatggtggagaggtagaagttccagcccaggcagatgtgcacaaacagagcccccgcgtacaggttcgcctgcctgcctgcatcacggggccattgtgaggttgggggaagacctggccgtggagctacaagcttgtgcggatgtcaggggacattactgttgctaataaagtccaaagtggccaatgcctttcccaaaaaaaaaa

SEQ ID NO: 737315 - DNA, 4781 bp, Homo sapiens
  misc_feature (2195)..(2195): n is a, c, g, or t
  misc_feature (2578)..(2578): n is a, c, g, or t
gtctcagaccaaaggcccccttatctgctccccagagcctgacgtccccccactgaattgtcacccctgagctgtctaaatgcgagggaccctaggtgaccactggtggctgtgctcaggccgggtcccccgaccttcaccccaaggctcagtgcgtggcatatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaactatggagaccaggtgcagcacttcaaggtgctgcgtgaggcctcggggaagtacttcctgtgggaggagaagttcaactccctcaacgagctggtcgacttctaccgcaccaccaccatcgccaagaagcggcagatcttcctgcgcgacgaggagcccttgctcaagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgactttcagctccccctggggcacccagcaccccaccacagggctagaaggccctaagacccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaatctaattttccttccaatgctgactgctttggtgctgtttttgaaatgtcacattattttctcccatttcccccctaatttttcagggctcccgctttgctggcttggccagttcttgggcaccgagctgctgtgcagctgtgaggggaatctgcccctcttggggcntcgggatccccatgagggaaatgggtggacctgaggactcagagctcctgcctttctgtccaggatggcagtgtcaggcgaagtaggcataaaagaatatgttgacacacatgaggaggatggcattgaagccacagacacgggcccagaaggcgtgtttctggggtgtttggccatcacctgctttagttcccaagggcacatcctgagccagggtccaccaggtaaggttctcaatctggacactctgtgggggtggggtcagcaggcttccagccaccacaacagcaccactgagtgcaaagagggcgacagcgaagtgcaggtagtggatgctccccaggacggctggccgcgtgtctggctctccgcacggtggggcngggttcaggaattccaggaccagcctcgtggcccccaccaccagccctgctatcaggccccagaaggccccctgctcgttggcacgtcgccagaagacgcccaggacaaagactgcagtcactggtggggccagggagctggtcactgactgcatgtagatgaagagttgcccgctgttggagtcctgcaggacggggatccaggccacactcacgccgatgagtgccactatgaccagccgtcccaccagcaggagctcccgctcgccggagcggggacgcagccgcctccagatgtccatagtgaagagggtgctgctgctgttgaagatggaggtcagcgacgacatgagcgccgccagcatcactgcgatcatcagcccccgcagaccgatgggcatcagttccatgaccagcttggggtaggcgatgttggagcagccgacctcggccccgcaggcccgcaggcactcggacggcaccacgcagcccacatcatctgttcgagagacggacacttggtgtctctcctcatagacatgagcacctgggaacaatgcgcggctgatcatgcccggcatgatgatcaggcccatggggagcatcttgaggtagctggccaggatggagcccgccttggcatggttcaggtcccgggctgacagtgatcgctgcacgatgacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctggaggggtcagggtggaacagggacagtttggtggttgcggggccctgactccctgggctcccccctgccttcatctcacaagaaacttcctgatgcatcaaacttgagttttttccacctcatctttcccagtgtttggaaaggtgtgagggtagagggttgtttttttttttaaggtgtatttgaatgactattttattcgtatttaaaataatactattaagtaagcattttgcacatgggcaccccagtgtcccgctggcccagcaggagtcactgttggcctctggacactcatcggccttgggcaagtggttctcagccaggtttccgattgtcgattcaaggaagcaaaagtaatttttcttgacatttgaggaccttcctgaggcttctaaagtgttcatcctgatcacctgaagggtgtgattttagcagagctgagagtggctggtggtgatgtggccccaccccctgaggcacagagaagagggagacaggtccagagagggatggggcctccaccaagaccatatagaccatctggcgggctcaagccggggctttttcctctccagtccaaaacacctcactgttcctgtctacctcggggtcagggcccggcatggccaagccctggcccatctgtgtctgtgtcactcccctcccttccagactgggcctggctgctgggatccctctcatgcggtgggtcccagggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcagagcaaatgaacaagtgccattcaagggttagaaactgctcagccacagggtcccagtgtctgagtctggaagagtctttagagatttgttcactctctgagggatcctcctggctctgcttacatacttccagggacggtgagctcacgctctctccgggcagccctgtgagtttcctatctgttccagactagtatcgccaatctctcccagctctcttctttcctccctggcctttgtcctgcaggaggtagcatcacctcttggcattttgtacatgcttttaaacaattggaggagctgcccaggcagttttatggcctcctggttgtgtgccttcacacccgcctgtcgacgcggccgcgaatttagtagtagtaggcggccgc

SEQ ID NO: 737316 - DNA, 4836 bp, Homo sapiens
  misc_feature (2195)..(2195): n is a, c, g, or t
  misc_feature (2578)..(2578): n is a, c, g, or t
  misc_feature (4661)..(4661): n is a, c, g, or t
  misc_feature (4684)..(4684): n is a, c, g, or t
  misc_feature (4731)..(4731): n is a, c, g, or t
  misc_feature (4742)..(4742): n is a, c, g, or t
  misc_feature (4760)..(4760): n is a, c, g, or t
  misc_feature (4763)..(4763): n is a, c, g, or t
  misc_feature (4774)..(4774): n is a, c, g, or t
  misc_feature (4779)..(4779): n is a, c, g, or t
  misc_feature (4782)..(4782): n is a, c, g, or t
  misc_feature (4792)..(4792): n is a, c, g, or t
  misc_feature (4798)..(4798): n is a, c, g, or t
  misc_feature (4815)..(4816): n is a, c, g, or t
  misc_feature (4822)..(4825): n is a, c, g, or t
  misc_feature (4834)..(4834): n is a, c, g, or t
gtctcagaccaaaggcccccttatctgctccccagagcctgacgtccccccactgaattgtcacccctgagctgtctaaatgcgagggaccctaggtgaccactggtggctgtgctcaggccgggtcccccgaccttcaccccaaggctcagtgcgtggcatatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaactatggagaccaggtgcagcacttcaaggtgctgcgtgaggcctcggggaagtacttcctgtgggaggagaagttcaactccctcaacgagctggtcgacttctaccgcaccaccaccatcgccaagaagcggcagatcttcctgcgcgacgaggagcccttgctcaagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgactttcagctccccctggggcacccagcaccccaccacagggctagaaggccctaagacccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaatctaattttccttccaatgctgactgctttggtgctgtttttgaaatgtcacattattttctcccatttcccccctaatttttcagggctcccgctttgctggcttggccagttcttgggcaccgagctgctgtgcagctgtgaggggaatctgcccctcttggggcntcgggatccccatgagggaaatgggtggacctgaggactcagagctcctgcctttctgtccaggatggcagtgtcaggcgaagtaggcataaaagaatatgttgacacacatgaggaggatggcattgaagccacagacacgggcccagaaggcgtgtttctggggtgtttggccatcacctgctttagttcccaagggcacatcctgagccagggtccaccaggtaaggttctcaatctggacactctgtgggggtggggtcagcaggcttccagccaccacaacagcaccactgagtgcaaagagggcgacagcgaagtgcaggtagtggatgctccccaggacggctggccgcgtgtctggctctccgcacggtggggcngggttcaggaattccaggaccagcctcgtggcccccaccaccagccctgctatcaggccccagaaggccccctgctcgttggcacgtcgccagaagacgcccaggacaaagactgcagtcactggtggggccagggagctggtcactgactgcatgtagatgaagagttgcccgctgttggagtcctgcaggacggggatccaggccacactcacgccgatgagtgccactatgaccagccgtcccaccagcaggagctcccgctcgccggagcggggacgcagccgcctccagatgtccatagtgaagagggtgctgctgctgttgaagatggaggtcagcgacgacatgagcgccgccagcatcactgcgatcatcagcccccgcagaccgatgggcatcagttccatgaccagcttggggtaggcgatgttggagcagccgacctcggccccgcaggcccgcaggcactcggacggcaccacgcagcccacatcatctgttcgagagacggacacttggtgtctctcctcatagacatgagcacctgggaacaatgcgcggctgatcatgcccggcatgatgatcaggcccatggggagcatcttgaggtagctggccaggatggagcccgccttggcatggttcaggtcccgggctgacagtgatcgctgcacgatgacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctggaggggtcagggtggaacagggacagtttggtggttgcggggccctgactccctgggctcccccctgccttcatctcacaagaaacttcctgatgcatcaaacttgagttttttccacctcatctttcccagtgtttggaaaggtgtgagggtagagggttgtttttttttttaaggtgtatttgaatgactattttattcgtatttaaaataatactattaagtaagcattttgcacatgggcaccccagtgtcccgctggcccagcaggagtcactgttggcctctggacactcatcggccttgggcaagtggttctcagccaggtttccgattgtcgattcaaggaagcaaaagtaatttttcttgacatttgaggaccttcctgaggcttctaaagtgttcatcctgatcacctgaagggtgtgattttagcagagctgagagtggctggtggtgatgtggccccaccccctgaggcacagagaagagggagacaggtccagagagggatggggcctccaccaagaccatatagaccatctggcgggctcaagccggggctttttcctctccagtccaaaacacctcactgttcctgtctacctcggggtcagggcccggcatggccaagccctggcccatctgtgtctgtgtcactcccctcccttccagactgggcctggctgctgggatccctctcatgcggtgggtcccagggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcagagcaaatgaacaagtgccattcaagggttagaaactgctcagccacagggtcccagtgtctgagtctggaagagtctttagagatttgttcactctctgagggatcctcctggctctgcttacatacttccagggacggtgagctcacgctctctccgggcagccctgtgagtttcctatctgttccagactagtatcgccaatctcctcgtgccgaattcggcacgaggtgtattaagcttttcaaacaatggaggggatgggccctngtgtcctgacgggagccaggtcngcctgagagctgtgccgctcctctgtcttgtcagtggaggtgcctgngtggtgagcangtctcaggcctcttgtcnctncccagtggctncaggnctnatagtggcangggcangatgaggctgcacccgnntggagnnnntttgttctngg

SEQ ID NO: 737317 - DNA, 4144 bp, Homo sapiens
  misc_feature (2195)..(2195): n is a, c, g, or t
  misc_feature (2578)..(2578): n is a, c, g, or t
gtctcagaccaaaggcccccttatctgctccccagagcctgacgtccccccactgaattgtcacccctgagctgtctaaatgcgagggaccctaggtgaccactggtggctgtgctcaggccgggtcccccgaccttcaccccaaggctcagtgcgtggcatatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaactatggagaccaggtgcagcacttcaaggtgctgcgtgaggcctcggggaagtacttcctgtgggaggagaagttcaactccctcaacgagctggtcgacttctaccgcaccaccaccatcgccaagaagcggcagatcttcctgcgcgacgaggagcccttgctcaagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgactttcagctccccctggggcacccagcaccccaccacagggctagaaggccctaagacccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaatctaattttccttccaatgctgactgctttggtgctgtttttgaaatgtcacattattttctcccatttcccccctaatttttcagggctcccgctttgctggcttggccagttcttgggcaccgagctgctgtgcagctgtgaggggaatctgcccctcttggggcntcgggatccccatgagggaaatgggtggacctgaggactcagagctcctgcctttctgtccaggatggcagtgtcaggcgaagtaggcataaaagaatatgttgacacacatgaggaggatggcattgaagccacagacacgggcccagaaggcgtgtttctggggtgtttggccatcacctgctttagttcccaagggcacatcctgagccagggtccaccaggtaaggttctcaatctggacactctgtgggggtggggtcagcaggcttccagccaccacaacagcaccactgagtgcaaagagggcgacagcgaagtgcaggtagtggatgctccccaggacggctggccgcgtgtctggctctccgcacggtggggcngggttcaggaattccaggaccagcctcgtggcccccaccaccagccctgctatcaggccccagaaggccccctgctcgttggcacgtcgccagaagacgcccaggacaaagactgcagtcactggtggggccagggagctggtcactgactgcatgtagatgaagagttgcccgctgttggagtcctgcaggacggggatccaggccacactcacgccgatgagtgccactatgaccagccgtcccaccagcaggagctcccgctcgccggagcggggacgcagccgcctccagatgtccatagtgaagagggtgctgctgctgttgaagatggaggtcagcgacgacatgagcgccgccagcatcactgcgatcatcagcccccgcagaccgatgggcatcagttccatgaccagcttggggtaggcgatgttggagcagccgacctcggccccgcaggcccgcaggcactcggacggcaccacgcagcccacatcatctgttcgagagacggacacttggtgtctctcctcatagacatgagcacctgggaacaatgcgcggctgatcatgcccggcatgatgatcaggcccatggggagcatcttgaggtagctggccaggatggagcccgccttggcatggttcaggtcccgggctgacagtgatcgctgcacgatgacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctttgattgtcaggatgacagcccccaccaccatgatgagcgtctgcagggcgtccgtgtagattacagcagccaggccccctgcgatggtgtacagggctgtgatgccgagcgtgaggatggtggagaggtagaagttccagcccaggcagatgtgcacaaacagagcccccgcgtacaggtcgatatcttggtgaagacagacagtagcagggacaggacagacaggtacatgcggatccgctggcccccgtagcgcttctgaatgtactcaggtaaggtgacgatctctgaggagatgtagatgggcacgaacacccatgccagtgccagcagcacgtacgtggcattccactcgaagcctgccacggccagacctcctgccgcgcctgagcccgccagtccaatgaagaggccagagccctcgctgctggcgaagagggaggctccaatcggccaccacgtcatgtcccggcctgccaggaagtagccattcaccgtgttcctactggcccgacaagaggaccatatgcccacggccacattcagagcaaaatacacagtgatgacgatgatgtcagccacgctcagctgcgtcccgggagtgtggaggtcgctggtggagttggcggccatggctgtcctgccgcaggcactaggtatgagcccgagggact

SEQ ID NO: 737318 - DNA, 4063 bp, Homo sapiens
  misc_feature (2195)..(2195): n is a, c, g, or t
  misc_feature (2578)..(2578): n is a, c, g, or t
gtctcagaccaaaggcccccttatctgctccccagagcctgacgtccccccactgaattgtcacccctgagctgtctaaatgcgagggaccctaggtgaccactggtggctgtgctcaggccgggtcccccgaccttcaccccaaggctcagtgcgtggcatatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaactatggagaccaggtgcagcacttcaaggtgctgcgtgaggcctcggggaagtacttcctgtgggaggagaagttcaactccctcaacgagctggtcgacttctaccgcaccaccaccatcgccaagaagcggcagatcttcctgcgcgacgaggagcccttgctcaagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgactttcagctccccctggggcacccagcaccccaccacagggctagaaggccctaagacccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaatctaattttccttccaatgctgactgctttggtgctgtttttgaaatgtcacattattttctcccatttcccccctaatttttcagggctcccgctttgctggcttggccagttcttgggcaccgagctgctgtgcagctgtgaggggaatctgcccctcttggggcntcgggatccccatgagggaaatgggtggacctgaggactcagagctcctgcctttctgtccaggatggcagtgtcaggcgaagtaggcataaaagaatatgttgacacacatgaggaggatggcattgaagccacagacacgggcccagaaggcgtgtttctggggtgtttggccatcacctgctttagttcccaagggcacatcctgagccagggtccaccaggtaaggttctcaatctggacactctgtgggggtggggtcagcaggcttccagccaccacaacagcaccactgagtgcaaagagggcgacagcgaagtgcaggtagtggatgctccccaggacggctggccgcgtgtctggctctccgcacggtggggcngggttcaggaattccaggaccagcctcgtggcccccaccaccagccctgctatcaggccccagaaggccccctgctcgttggcacgtcgccagaagacgcccaggacaaagactgcagtcactggtggggccagggagctggtcactgactgcatgtagatgaagagttgcccgctgttggagtcctgcaggacggggatccaggccacactcacgccgatgagtgccactatgaccagccgtcccaccagcaggagctcccgctcgccggagcggggacgcagccgcctccagatgtccatagtgaagagggtgctgctgctgttgaagatggaggtcagcgacgacatgagcgccgccagcatcactgcgatcatcagcccccgcagaccgatgggcatcagttccatgaccagcttggggtaggcgatgttggagcagccgacctcggccccgcaggcccgcaggcactcggacggcaccacgcagcccacatcatctgttcgagagacggacacttggtgtctctcctcatagacatgagcacctgggaacaatgcgcggctgatcatgcccggcatgatgatcaggcccatggggagcatcttgaggtagctggccaggatggagcccgccttggcatggttcaggtcccgggctgacagtgatcgctgcacgatgacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctgcgatggtgtacagggctgtgatgccgagcgtgaggatggtggagaggtagaagttccagcccaggcagatgtgcacaaacagagcccccgcgtacaggtcgatatcttggtgaagacagacagtagcagggacaggacagacaggtacatgcggatccgctggcccccgtagcgcttctgaatgtactcaggtaaggtgacgatctctgaggagatgtagatgggcacgaacacccatgccagtgccagcagcacgtacgtggcattccactcgaagcctgccacggccagacctcctgccgcgcctgagcccgccagtccaatgaagaggccagagccctcgctgctggcgaagagggaggctccaatcggccaccacgtcatgtcccggcctgccaggaagtagccattcaccgtgttcctactggcccgacaagaggaccatatgcccacggccacattcagagcaaaatacacagtgatgacgatgatgtcagccacgctcagctgcgtcccgggagtgtggaggtcgctggtggagttggcggccatggctgtcctgccgcaggcactaggtatgagcccgagggact

SEQ ID NO: 737319 - DNA, 1236 bp, Homo sapiens
  misc_feature (1236)..(1236): n is a, c, g, or t
gtctcagaccaaaggcccccttatctgctccccagagcctgacgtccccccactgaattgtcacccctgagctgtctaaatgcgagggaccctaggtgaccactggtggctgtgctcaggccgggtcccccgaccttcaccccaaggctcagtgcgtggcatatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaaagcccagaggggtccctgcctgggcccaaaatcacacagcagattggggtagagccggagaggacccgagactcctgtgccagcctgggcatcccctccactgccagggaaggactgcatccaagtcgcatccgtacccaggccgaggtgtccgaggcccaggctgaaatccggttgctgctgcagagaccaagtttccaaggccttgtcaagtgggctgtgccagacgatccccaggcctgtcattggctgctcttcggctcggacacaccaaacctcaccaagcacttccatttctgagggaatagaggttgtggcttccgtcaagcacccatttaccccaccctcctcctcctcttcctgcaaacttgagtcacagctgccctgctgggctcaggccccagggatgtctgagtcagcctggctggggttccagtcctgacaccgcccttaccagctgggagactccgggaacctccaaccctgctgagcctccacttcgacatccgtgaaacagccatgaataagcaggtctcaaaggtcgactcctgtatgcagggacacagcatgcagtaggtgcccaatcataacagcagcacccacctggagccccttatagcagcccttctcctctgcacttccacatggcatctcatttaaccttcaccacaacccaactaggaaggcaccatcattatcccattttactgatgaagaaactgaggcccaggaaggtgaatttaccagccagctcacaaatggactagtagatggcagtttgtggattggagcccagaggctgtgctcctgcccacaccctctcaaatgagggctataaaataacactctaagn

SEQ ID NO: 737320 - DNA, 5598 bp, Homo sapiens
  misc_feature (2096)..(2096): n is a, c, g, or t
  misc_feature (2479)..(2479): n is a, c, g, or t
caagggcaagagcaataaacacgactcttagctgcacgtcactttacagtttataaggcccattctcatggctttgtggcctggagtcaaaagctaccatggctgctgcagagtcgggtaaataagatcccaagagaagcagggacctaaccaaaatcccaccctaaggaccaggactcaggtcccctgacccaccagccctattgtcccagctgggcggctgggaaagccgtgttctatgtagatgcagcatctgcacagcagacaggcaggggtgtgggcagcaggaggcccagtggtggcactaccattgatctggacttaaagttcaactccggtgctgcccgagacccctcctcacctgtggcaaatcacttctcttgggtgcctctgagggagggtgggttgcagggcttctgaaggcaccctactaaccacctcctcttcttgcagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgactttcagctccccctggggcacccagcaccccaccacagggctagaaggccctaagacccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaatctaattttccttccaatgctgactgctttggtgctgtttttgaaatgtcacattattttctcccatttcccccctaatttttcagggctcccgctttgctggcttggccagttcttgggcaccgagctgctgtgcagctgtgaggggaatctgcccctcttggggcntcgggatccccatgagggaaatgggtggacctgaggactcagagctcctgcctttctgtccaggatggcagtgtcaggcgaagtaggcataaaagaatatgttgacacacatgaggaggatggcattgaagccacagacacgggcccagaaggcgtgtttctggggtgtttggccatcacctgctttagttcccaagggcacatcctgagccagggtccaccaggtaaggttctcaatctggacactctgtgggggtggggtcagcaggcttccagccaccacaacagcaccactgagtgcaaagagggcgacagcgaagtgcaggtagtggatgctccccaggacggctggccgcgtgtctggctctccgcacggtggggcngggttcaggaattccaggaccagcctcgtggcccccaccaccagccctgctatcaggccccagaaggccccctgctcgttggcacgtcgccagaagacgcccaggacaaagactgcagtcactggtggggccagggagctggtcactgactgcatgtagatgaagagttgcccgctgttggagtcctgcaggacggggatccaggccacactcacgccgatgagtgccactatgaccagccgtcccaccagcaggagctcccgctcgccggagcggggacgcagccgcctccagatgtccatagtgaagagggtgctgctgctgttgaagatggaggtcagcgacgacatgagcgccgccagcatcactgcgatcatcagcccccgcagaccgatgggcatcagttccatgaccagcttggggtaggcgatgttggagcagccgacctcggccccgcaggcccgcaggcactcggacggcaccacgcagcccacatcatctgttcgagagacggacacttggtgtctctcctcatagacatgagcacctgggaacaatgcgcggctgatcatgcccggcatgatgatcaggcccatggggagcatcttgaggtagctggccaggatggagcccgccttggcatggttcaggtcccgggctgacagtgatcgctgcacgatgacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctggaggggtcagggtggaacagggacagtttggtggttgcggggccctgactccctgggctcccccctgccttcatctcacaagaaacttcctgatgcatcaaacttgagttttttccacctcatctttcccagtgtttggaaaggtgtgagggtagagggttgtttttttttttaaggtgtatttgaatgactattttattcgtatttaaaataatactattaagtaagcattttgcacatgggcaccccagtgtcccgctggcccagcaggagtcactgttggcctctggacactcatcggccttgggcaagtggttctcagccaggtttccgattgtcgattcaaggaagcaaaagtaatttttcttgacatttgaggaccttcctgaggcttctaaagtgttcatcctgatcacctgaagggtgtgattttagcagagctgagagtggctggtggtgatgtggccccaccccctgaggcacagagaagagggagacaggtccagagagggatggggcctccaccaagaccatatagaccatctggcgggctcaagccggggctttttcctctccagtccaaaacacctcactgttcctgtctacctcggggtcagggcccggcatggccaagccctggcccatctgtgtctgtgtcactcccctcccttccagactgggcctggctgctgggatccctctcatgcggtgggtcccagggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcagagcaaatgaacaagtgccattcaagggttagaaactgctcagccacagggtcccagtgtctgagtctggaagagtctttagagatttgttcactctctgagggatcctcctggctctgcttacatacttccagggacggtgagctcacgctctctccgggcagccctgtgagtttcctatctgttccagactagtatcgccaatctctcccagctctcttctttcctccctggcctttgtcctgcaggaggtagcatcacctcttggcattttgtacatgcttttaaacaattggaggagctgcccaggcagttttatggcctcctggttgtgtgccttcacacccgcctacagccccacctcaccatcaagcgctgagccaatgcgggtgtggctggccctgagttcctgagtcagctccttgccagggccagagctggtaacagcggggcagcagggtgggtagcctctaccagccagggcagtccctgaggggccagcaggggggctgactgcctagtggctcaacctcctgaacccacccactcccagcgatgctacccagaaccccaacggcatgaatcctgcacagtgccgggcagtgccagactccaaagggctcgctgtggggacagccccgccatggccacagactctgtcctcacctttgattgtcaggatgacagcccccaccaccatgatgagcgtctgcagggcgtccgtgtagattacagcagccaggccccctgccagtggaagcaaggttgctggagggggccctggccccagggaggagggacacggggaggaacttctggggctcctgctggggccacttcctgggctgctccctcgggcctgtagggggaggtggccttctgacccctttacacgtcccctgggtggacctccctgctgcaggcaccatacctgcgatggtgtacagggctgtgatgccgagcgtgaggatggtggagaggtagaagttccagcccaggcagatgtgcacaaacagagcccccgcgtacaggtccagctgcggagggagagagccttgtgtgggactgttattcccagggctccagcaagccactccctgggtgacctcgggcaaggccctctctgggcctcggtggcctgtggataaggaggggagacccccactcgcctgcctgcctgcatcacggggccattgtgaggttgggggaagacctggccgtggagctacaagcttgtgcggatgtcaggggacattactgttgctaataaagtccaaagtggccaatgcctttcccaaaaaaaaaa

SEQ ID NO: 737321 - DNA, 3740 bp, Homo sapiens
ctggaacccccagcccagccagatgaaccgcatcaagatccgtgacacctcccaggccagcgcccagcaccagctgtggaagcagagccaggacagcaggccccgtccagagccttgccctcccccagagcccagtgccccccaggacggtgtcccagctgagaacggcctcccccagggggaccctgagccattgccccccgtgcccaagccccggacagtccctgtggcagatgtactagcccgggacagcagtgatattggctgggtcctggagctccccaaagaggaagctccccagaatgggacagaccataggctacccaggatggcaggcccaggccacgccccactccagcggcagctatctgtgacccaggatgaccccgagagcctcggggtggggctccccaatgggctggatggggtggaagaagaagatgatgacgactacgtaaccctcagtgaccaggacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccaggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctagcagcatgtcccagcctggagccacaccttctgaggccccagcccagactcatgacgcggagggcagacaggccgcctgggcctaccagagcccactgggacggcaggaaggtgggatgggcgggagacgttggcactcacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctggaggggtcagggtggaacagggacagtttggtggttgcggggccctgactccctgggctcccccctgccttcatctcacaagaaacttcctgatgcatcaaacttgagttttttccacctcatctttcccagtgtttggaaaggtgtgagggtagagggttgtttttttttttaaggtgtatttgaatgactattttattcgtatttaaaataatactattaagtaagcattttgcacatgggcaccccagtgtcccgctggcccagcaggagtcactgttggcctctggacactcatcggccttgggcaagtggttctcagccaggtttccgattgtcgattcaaggaagcaaaagtaatttttcttgacatttgaggaccttcctgaggcttctaaagtgttcatcctgatcacctgaagggtgtgattttagcagagctgagagtggctggtggtgatgtggccccaccccctgaggcacagagaagagggagacaggtccagagagggatggggcctccaccaagaccatatagaccatctggcgggctcaagccggggctttttcctctccagtccaaaacacctcactgttcctgtctacctcggggtcagggcccggcatggccaagccctggcccatctgtgtctgtgtcactcccctcccttccagactgggcctggctgctgggatccctctcatgcggtgggtcccagggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcagagcaaatgaacaagtgccattcaagggttagaaactgctcagccacagggtcccagtgtctgagtctggaagagtctttagagatttgttcactctctgagggatcctcctggctctgcttacatacttccagggacggtgagctcacgctctctccgggcagccctgtgagtttcctatctgttccagactagtatcgccaatctctcccagctctcttctttcctccctggcctttgtcctgcaggaggtagcatcacctcttggcattttgtacatgcttttaaacaattggaggagctgcccaggcagttttatggcctcctggttgtgtgccttcacacccgcctacagccccacctcaccatcaagcgctgagccaatgcgggtgtggctggccctgagttcctgagtcagctccttgccagggccagagctggtaacagcggggcagcagggtgggtagcctctaccagccagggcagtccctgaggggccagcaggggggctgactgcctagtggctcaacctcctgaacccacccactcccagcgatgctacccagaaccccaacggcatgaatcctgcacagtgccgggcagtgccagactccaaagggctcgctgtggggacagccccgccatggccacagactctgtcctcacctttgattgtcaggatgacagcccccaccaccatgatgagcgtctgcagggcgtccgtgtagattacagcagccaggccccctgccagtggaagcaaggttgctggagggggccctggccccagggaggagggacacggggaggaacttctggggctcctgctggggccacttcctgggctgctccctcgggcctgtagggggaggtggccttctgacccctttacacgtcccctgggtggacctccctgctgcaggcaccatacctgcgatggtgtacagggctgtgatgccgagcgtgaggatggtggagaggtagaagttccagcccaggcagatgtgcacaaacagagcccccgcgtacaggtccagctgcggagggagagagccttgtgtgggactgttattcccagggctccagcaagccactccctgggtgacctcgggcaaggccctctctgggcctcggtggcctgtggataaggaggggagacccccactcgcctgcctgcctgcatcacggggccattgtgaggttgggggaagacctggccgtggagctacaagcttgtgcggatgtcaggggacattactgttgctaataaagtccaaagtggccaatgcctttcccaaaaaaaaaa

SEQ ID NO: 737322 - DNA, 214 bp, Homo sapiens; identical to SEQ ID NO: 385373

SEQ ID NO: 737323 - DNA, 4169 bp, Homo sapiens
ggaatacaatttctagaagcagtcccaaattcattggtcattcccctcaacctctaggctatgacaggtcatcccgctcttcctatgtggatgaggactgtgactccctggccctctgtgatcctctgcagaggacaaattgtgaagttgacagcctgcctgaaagctgcttcgacagcggcttgtctaccttgagagatcccaatgagtatgactcagaagtggaatacaagcaccagaggggatttcagaggtcacacggggtgcaggagagctttggaggtgatgcttcagacacagatgttcctgacataagggatgaagagacatttggtttagaagatgtggcttccgtcttagactggaagccccaagggtctgttagtgaaggcagcattgttagttcatcaagaaagcccatctcagcactctcgccccagacagacctggtagatgacaacgctaaatcttttagctcacagaaggcttacaagattgtacttgctggggacgctgcagtggggaagtctagtttcctcatgagactttgcaagaatgaatttcgagaaaatataagcgccaccctgggagttgatttccaaatgaaaaccctcattgtggatggagaacgaacagttctgcagctctgggatacagctggtcaggagagattcagaagtattgccaagtcttacttcagaaaggcagatggtgttttgctgctgtatgatgttacatgtgagaaaagctttcttaacatacgagaatgggtagatatgattgaggatgcagcccatgagactgttcccattatgctggtaggaaacaaggctgacattcgtgacactgctgctacagagggacaaaaatgtgtcccagggcactttggagagaaactggccatgacgtatggggcattattctgtgaaacaagtgccaaagatggttctaacatagtggaggctgttctgcaccttgctcgagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttacagtgcaggaaacctgaacccagctctcaggtccctctggaactttggctcttctttgttttgtctcagtgagtgatttgggccctctggctaaatagactagtcatgtccttacaggtcttaaaagataacatgtaaatgtttttaaaatggtaaaaaaaaagaaaagaaaagaaatcacatgctcagatcaaagctgtagaggaaactgacataattagattcatgtggtagctgaattaggttacccacaaagtcagcatttaaatatttgatactaaagttctagtaagaagggattctcatcctagctttgctgttaactggccttgtgaccttggacatgtcacaagcccatgtcggatctgtttcttcatctgtaaaatgtgcagcttgccctcaaaggccttgcagcccttggcacctcagattctgtgggaagcagtaggacagagagtgtggtggcccacagttaataatagaactatggttattcctgctttttaatattggagtattgatttttctcacttctgaaataaggacagaatttgattaaaaaatggaaacagaaatatctattttttatgtataaagaaacatgtttgagacaaaaatagttgtatataaaaggatatttcataatctcagaatagttacaaagctcactgcttgaatttggtgttaaaaattctaatggaaacatgtaaagccacatactactgaaagcacaatgcccaggaaagttgtcactcttcacttaagggagtggttgccaggggctgagaaagggaggatggggagtgactgctaataggtatgtggtttctttgggcgatgatgagaatgttctggaattggaatagtggtgatagttgtataactgtttgaatgtactaggaaccactgaattgtatactttgaaagggtgaattttatggttgtgaattatctcactaaaaaaaatgctagtacttagagtgatgtaacattttgcaaaattttcattttcgtatccctgctgatttcaaaccttcccatggtttagaagcataacctgtaatgtaatgcaagtcccctaactccctggttgctaacattaacttccttaagtaataatcaatgaaagaaattctatgcatggttttgaaataatatccttgaaagaggaatcaccattaggaaaggtgagtcagggtcctttgtttaatgtgactagtggctcatcatcaccagtgacctggttgggcctactctccttccagaacctgcattgcttcccagacctccccactgagatgcctctaagagccaaaggagtcaacacttgagcctagggtgggctacaacaaaagattctaatttaccttgcttcatctaggtccaggccccaagtagcttgctgaaggaacttaaaaagtagctgttatttattgtattgtataagctaaaaacatttatttttgttgaatcgaaacaattccatgtagcaatcttttttctgttcacggtgtttgtgatagaaccttaaattccgcaagcatcagttttttgaaaaaatgggaattgaccggatagttacaggcaaagattataaatagctacaacatcatttaacttttataaacatgccttctctctattgaagacatctgatatttttgctggaaagttggatctatcctcagtaactctgccatgaattcctgtttcctggttccagaaaaagaaaagattacatttctgatcataaagaatgtcttgcatatgggaaatttttcaaaataaggggggtattatttatgtggcatgggaaaacttttgccatggctgtttgtcttagtggcatcttttgatgacattggatcagatatatgtagatgctgatatatgggacacatgtttaggttttggtgcagttgcacaaaactgtgttagtttatatgttactgtgttgcctttatttattctctccaaagtgtctctttatatttgttttacaatctgtgaaagagtataccataatacagaagtattttcatagtctttacctctggattgtcctgtcagtatagccacgttgatgagattacaccagtgcctttgatcatctttaagtatttgagccctgataaatattttggtaacataatccaaattagagacttagagctctggttagcaatcatgtttaaagagaagcttcttaaagctctgtatgctgggagattcatgattattaccaacgttttgatttcatgaaggtgttctcaaatttaaagcacattttcagtaagaacaaaaatatttaatgtttttatcttagacttaacttgatacatttgcatattactatggaagttattcaccttgtccctgtttttctttaagatattttaaaatcatagttatactacagtccttttttaaatgtatcctgatacattgtaaaatattttaatttcattgtggaaaataatgttggataaggagatatttttcactgttaacttttagcccatgcattttcataatttatttttttcacttgctgctttatatgacatatgtgacatttgattatttaacacttgatgtgatctgcataaacccaagttgcacaaccctcctgctgaagataaaattgaggttaaagataaagatttattttcatatttgtacagtgatcggcttcagtgatggtttttgtgggcatttattgtgtgtgtgtaagaaatttcatatgtatatattaagtaggcctctgagtattgaataattgttttatgattttgatttatatggtttacattttcattgtgtgggccatatttcgtttatactgtttatttctcttcaaaccttaataattataccataaagtgtaatttttatagcaatgcaaatgtctaaggaactacaaatattttctacgttgtaaattcaataaagcttgcttcctttggc

SEQ ID NO: 737324 - DNA, 1998 bp, Homo sapiens
ggaatacaatttctagaagcagtcccaaattcattggtcattcccctcaacctctaggctatgacaggtcatcccgctcttcctatgtggatgaggactgtgactccctggccctctgtgatcctctgcagaggacaaattgtgaagttgacagcctgcctgaaagctgcttcgacagcggcttgtctaccttgagagatcccaatgagtatgactcagaagtggaatacaagcaccagaggggatttcagaggtcacacggggtgcaggagagctttggaggtgatgcttcagacacagatgttcctgacataagggatgaagagacatttggtttagaagatgtggcttccgtcttagactggaagccccaagggtctgttagtgaaggcagcattgttagttcatcaagaaagcccatctcagcactctcgccccagacagacctggtagatgacaacgctaaatcttttagctcacagaaggcttacaagattgtacttgctggggacgctgcagtggggaagtctagtttcctcatgagactttgcaagaatgaatttcgagaaaatataagcgccaccctgggagttgatttccaaatgaaaaccctcattgtggatggagaacgaacagttctgcagctctgggatacagctggtcaggagagattcagaagtattgccaagtcttacttcagaaaggcagatggtgttttgctgctgtatgatgttacatgtgagaaaagctttcttaacatacgagaatgggtagatatgattgaggatgcagcccatgagactgttcccattatgctggtaggaaacaaggctgacattcgtgacactgctgctacagagggacaaaaatgtgtcccagggcactttggagagaaactggccatgacgtatggggcattattctgtgaaacaagtgccaaagatggttctaacatagtggaggctgttctgcaccttgctcgagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttacagtgcaggaaacctgaacccagctctcaggtccctctggaactttggctcttctttgttttgtctcagtgagtgatttgggccctctggctaaatagactagtcatgtccttacaggtcttaaaagataacatgtaaatgtttttaaaatggtaaaaaaaaagaaaagaaaagaaatcacatgctcagatcaaagctgtagaggaaactgacataattagattcatgtggtagctgaattaggttacccacaaagtcagcatttaaatatttgatactaaagttctagtaagaagggattctcatcctagctttgctgttaactggccttgtgaccttggacatgtcacaagcccatgtcggatctgtttcttcatctgtaaaatgtgcagcttgccctcaaaggccttgcagcccttggcacctcagattctgtgggaagcagtaggacagagagtgtggtggcccacagttaataatagaactatggttattcctgctttttaatattggagtattgatttttctcacttctgaaataaggacagaatttgattaaaaaatggaaacagaaatatctattttttatgtataaagaaacatgtttgagacaaaaatagttgtatataaaaggatatttcataatctcagaatagtttatgctgtggaggagctaattaaactcatttctgggcattttacagtctatgaggagcttagagttttctcctttctgctagctctcttagaacaatacagacagtttctgtctcctccctgcaatagtttatgctgt

SEQ ID NO: 737325 - DNA, 1405 bp, Homo sapiens
ggaatacaatttctagaagcagtcccaaattcattggtcattcccctcaacctctaggctatgacaggtcatcccgctcttcctatgtggatgaggactgtgactccctggccctctgtgatcctctgcagaggacaaattgtgaagttgacagcctgcctgaaagctgcttcgacagcggcttgtctaccttgagagatcccaatgagtatgactcagaagtggaatacaagcaccagaggggatttcagaggtcacacggggtgcaggagagctttggaggtgatgcttcagacacagatgttcctgacataagggatgaagagacatttggtttagaagatgtggcttccgtcttagactggaagccccaagggtctgttagtgaaggcagcattgttagttcatcaagaaagcccatctcagcactctcgccccagacagacctggtagatgacaacgctaaatcttttagctcacagaaggcttacaagattgtacttgctggggacgctgcagtggggaagtctagtttcctcatgagactttgcaagaatgaatttcgagaaaatataagcgccaccctgggagttgatttccaaatgaaaaccctcattgtggatggagaacgaacagttctgcagctctgggatacagctggtcaggagagattcagaagtattgccaagtcttacttcagaaaggcagatggtgttttgctgctgtatgatgttacatgtgagaaaagctttcttaacatacgagaatgggtagatatgattgaggatgcagcccatgagactgttcccattatgctggtaggaaacaaggctgacattcgtgacactgctgctacagagggacaaaaatgtgtcccagggcactttggagagaaactggccatgacgtatggggcattattctgtgaaacaagtgccaaagatggttctaacatagtggaggctgttctgcaccttgctcgagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttacagtgcaggaaacctgaacccagctctcaggtccctctggaactttggctcttctttgttttgtctcagtgagtgatttgggccctctggctaaatagactagtcatgtccttacaggtcttaaaagataacatgtaaatgtttttaaaatggtaaaaaaaaaagtcgacgcggccgcgaatttagtagtagtaggcggccgc

SEQ ID NO: 737326 - DNA, 3246 bp, Homo sapiens
cagtaatcctctctctctctctctctctctctctctgtctctctctatctctgtctcagagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttacagtgcaggaaacctgaacccagctctcaggtccctctggaactttggctcttctttgttttgtctcagtgagtgatttgggccctctggctaaatagactagtcatgtccttacaggtcttaaaagataacatgtaaatgtttttaaaatggtaaaaaaaaagaaaagaaaagaaatcacatgctcagatcaaagctgtagaggaaactgacataattagattcatgtggtagctgaattaggttacccacaaagtcagcatttaaatatttgatactaaagttctagtaagaagggattctcatcctagctttgctgttaactggccttgtgaccttggacatgtcacaagcccatgtcggatctgtttcttcatctgtaaaatgtgcagcttgccctcaaaggccttgcagcccttggcacctcagattctgtgggaagcagtaggacagagagtgtggtggcccacagttaataatagaactatggttattcctgctttttaatattggagtattgatttttctcacttctgaaataaggacagaatttgattaaaaaatggaaacagaaatatctattttttatgtataaagaaacatgtttgagacaaaaatagttgtatataaaaggatatttcataatctcagaatagttacaaagctcactgcttgaatttggtgttaaaaattctaatggaaacatgtaaagccacatactactgaaagcacaatgcccaggaaagttgtcactcttcacttaagggagtggttgccaggggctgagaaagggaggatggggagtgactgctaataggtatgtggtttctttgggcgatgatgagaatgttctggaattggaatagtggtgatagttgtataactgtttgaatgtactaggaaccactgaattgtatactttgaaagggtgaattttatggttgtgaattatctcactaaaaaaaatgctagtacttagagtgatgtaacattttgcaaaattttcattttcgtatccctgctgatttcaaaccttcccatggtttagaagcataacctgtaatgtaatgcaagtcccctaactccctggttgctaacattaacttccttaagtaataatcaatgaaagaaattctatgcatggttttgaaataatatccttgaaagaggaatcaccattaggaaaggtgagtcagggtcctttgtttaatgtgactagtggctcatcatcaccagtgacctggttgggcctactctccttccagaacctgcattgcttcccagacctccccactgagatgcctctaagagccaaaggagtcaacacttgagcctagggtgggctacaacaaaagattctaatttaccttgcttcatctaggtccaggccccaagtagcttgctgaaggaacttaaaaagtagctgttatttattgtattgtataagctaaaaacatttatttttgttgaatcgaaacaattccatgtagcaatcttttttctgttcacggtgtttgtgatagaaccttaaattccgcaagcatcagttttttgaaaaaatgggaattgaccggatagttacaggcaaagattataaatagctacaacatcatttaacttttataaacatgccttctctctattgaagacatctgatatttttgctggaaagttggatctatcctcagtaactctgccatgaattcctgtttcctggttccagaaaaagaaaagattacatttctgatcataaagaatgtcttgcatatgggaaatttttcaaaataaggggggtattatttatgtggcatgggaaaacttttgccatggctgtttgtcttagtggcatcttttgatgacattggatcagatatatgtagatgctgatatatgggacacatgtttaggttttggtgcagttgcacaaaactgtgttagtttatatgttactgtgttgcctttatttattctctccaaagtgtctctttatatttgttttacaatctgtgaaagagtataccataatacagaagtattttcatagtctttacctctggattgtcctgtcagtatagccacgttgatgagattacaccagtgcctttgatcatctttaagtatttgagccctgataaatattttggtaacataatccaaattagagacttagagctctggttagcaatcatgtttaaagagaagcttcttaaagctctgtatgctgggagattcatgattattaccaacgttttgatttcatgaaggtgttctcaaatttaaagcacattttcagtaagaacaaaaatatttaatgtttttatcttagacttaacttgatacatttgcatattactatggaagttattcaccttgtccctgtttttctttaagatattttaaaatcatagttatactacagtccttttttaaatgtatcctgatacattgtaaaatattttaatttcattgtggaaaataatgttggataaggagatatttttcactgttaacttttagcccatgcattttcataatttatttttttcacttgctgctttatatgacatatgtgacatttgattatttaacacttgatgtgatctgcataaacccaagttgcacaaccctcctgctgaagataaaattgaggttaaagataaagatttattttcatatttgtacagtgatcggcttcagtgatggtttttgtgggcatttattgtgtgtgtgtaagaaatttcatatgtatatattaagtaggcctctgagtattgaataattgttttatgattttgatttatatggtttacattttcattgtgtgggccatatttcgtttatactgtttatttctcttcaaaccttaataattataccataaagtgtaatttttatagcaatgcaaatgtctaaggaactacaaatattttctacgttgtaaattcaataaagcttgcttcctttggc

SEQ ID NO: 737327 - DNA, 454 bp, Homo sapiens
tccaacatgacaccccccgaagccccaacaccaggtggctggctgtccctgcccaggaaacagggctccctggatttgtccccagcaggaaccagtgagccaggaacagactgacaactgccacaacaccctcctcagccctcgacatgtgcctcgcaaggactcagacccctatccacccccagtccccagggccccctgccagcccctgtcctacaggggcaagacggcaggaccaggcatgggggagctggaggcagggactagaacagagggagccacctggagagacggaggctgtcagtgcctgcctcgatacctctctctgcagagagcttctgggtgggggcttatctcctcccccaggagggtggatctctgtccctctatccccagggactctctcccctcttgtatagaataaaaaaacaaaatcatcgcctaaaaaaagtct

SEQ ID NO: 737328 - DNA, 1682 bp, Homo sapiens
ggagctcacccgcgagttgcaagacagcatccggaggtgcctgagccaaggggccgtgctccaacaacatcatgtgaagttggagacaaagcccaagaagtttgaggaccgagtgctggccctgacctcctggcgcctccacctcttcctccttaaagtcccggccaaggtggagagctccttcaatgtcctggagatccgtgccttcaacacgctcagtcagaatcagatcctggtggagacggagcgtggcatggtgagcatgcgactgccatcagctgaaagtgtggaccaggtgacacgacatgtgagctctgccctgtccaaggtctgccctggccctgggtgtttgatccggcgtggaaacgcagacaccccagaggggccccgagatacatcccccaactctgagacttccacatctaccacccacagtgtctgcggtggcttctctgagacctacgctgctctgtgtgactacaatgggctacactgccgtgaggaggttcaatgggatgtggacaccatctaccatgctgaagataaccgggagttcaatcttttggatttcagccacttggagagccgagacttggccctaatggtagcagccctggcctacaaccagtggttcaccaaactctactgcaaggacttgcggctgggctctgaagtgctagaacaggtgctacataccctaagcaagtcggggagcctcgaagagctggtgctggacaacgccgggcttaagacggactttgtccagaagctggccggggtgtttggggagaacgggagctgtgtgctgcatgccctcactctgtcccacaaccccatcgaggacaagggttttctcagtctgagccagcagctcctctgcttcccctctggcctcaccaaactgtgcctggccaagactgccatttcccctcgagggctccaggcactcggccagaccttcggggcaaacccagcatttgccagctcccttcgatacctggacctgagcaagaatcctgggctcctcgccacggatgaggccaatgccctctacagtttcctggcccaacccaacgccctggtgcacctggacctgtcaggaactgactgcgtcatcgacttgcttctcggtgccctgctccacggctgctgctcccacctcacctacctcaacctggctcgcaacagctgctcccacaggggtctctccacaggaagggtcgagaggccccgccggccttcaagcagttcttcagcagcgcctacacactgagccacgtcaatctgtcggccacaaagctgcccctggaggccctcagggcgctgcttcagggcctctccctcaacagtcacctcagtgacctgcacctggatctcagcagctgcgagctccgttcagcgggagcccaagccttgcaggagcagctgggagctgtcacctgtgtaggcagcctggatctgtcagacaatgggttcgactcggacctcctgacactggtgcctgcacttggcaagaacaagtccctcaagcacctgtttttgggcaagaacttcaatgtcaaggccaagtgaggccccctttccatgcccacagaccctcatcccatcattcacccatcctcttggctcaccgtattacctctggccacctctctcctcctccaatagcatgaccccagccc

SEQ ID NO: 737329 - DNA, 4059 bp, Homo sapiens
  misc_feature (2112)..(2112): n is a, c, g, or t
ggagctcacccgcgagttgcaagacagcatccggaggtgcctgagccaaggggccgtgctccaacaacatcatgtgaagttggagacaaagcccaagaagtttgaggaccgagtgctggccctgacctcctggcgcctccacctcttcctccttaaagtcccggccaaggtggagagctccttcaatgtcctggagatccgtgccttcaacacgctcagtcagaatcagatcctggtggagacggagcgtggcatggtgagcatgcgactgccatcagctgaaagtgtggaccaggtgacacgacatgtgagctctgccctgtccaaggtctgccctggccctgggtgtttgatccggcgtggaaacgcagacaccccagaggggccccgagatacatcccccaactctgagacttccacatctaccacccacagtgtctgcggtggcttctctgagacctacgctgctctgtgtgactacaatgggctacactgccgtgaggaggttcaatgggatgtggacaccatctaccatgctgaagataaccgggagttcaatcttttggatttcagccacttggagagccgagacttggccctaatggtagcagccctggcctacaaccagtggttcaccaaactctactgcaaggacttgcggctgggctctgaagtgctagaacaggtgctacataccctaagcaagtcggggagcctcgaagagctggtgctggacaacgccgggcttaagacggactttgtccagaagctggccggggtgtttggggagaacgggagctgtgtgctgcatgccctcactctgtcccacaaccccatcgaggacaagggttttctcagtctgagccagcagctcctctgcttcccctctggcctcaccaaactgtgcctggccaagactgccatttcccctcgagggctccaggcactcggccagaccttcggggcaaacccagcatttgccagctcccttcgatacctggacctgagcaagaatcctgggctcctcgccacggatgaggccaatgccctctacagtttcctggcccaacccaacgccctggtgcacctggacctgtcaggaactgactgcgtcatcgacttgcttctcggtgccctgctccacggctgctgctcccacctcacctacctcaacctggctcgcaacagctgctcccacaggggtctctccacaggaagggtcgagaggccccgccggccttcaagcagttcttcagcagcgcctacacactgagccacgtcaatctgtcggccacaaagctgcccctggaggccctcagggcgctgcttcagggcctctccctcaacagtcacctcagtgacctgcacctggatctcagcagctgcgagctccgttcagcgggagcccaagccttgcaggagcagctgggagctgtcacctgtgtaggcagcctggatctgtcagacaatgggttcgactcggacctcctgacactggtgcctgcacttggcaagaacaagtccctcaagcacctgtttttgggcaagaacttcaatgtcaaggccaagaccctggaggagatcctccacaagctggtgcagctgatccaggaagaggactgttccctgcagtcactgtcggtggcagactcccggctgaagcttcgcaccagcatcctcatcaatgccctgggcagcaacacctgcctggccaaggtggatctgagcggcaatggcatggaggacatcggggccaagatgctgtctaaggccctgcagataaactcctccctcagaactatcctatgggatcggaacaatacatctgccctgggcttcctggacatcgcaagggccctggagagcaaccacacgctgcgcttcatgtccttccccgtgagcgacatctcccaagcctatcgcagcgcgcctgagcgcaccgaggacgtctggcagaagatccaatggtgcttagtgaggaacaaccactcccagacgtgcccccaggagcaggccttcaggttgcagcagggcctggtgaccagcagcgccgagcaaatgctgcagcggctgtgtggacgagtgcaggaggaggtgcgggccctgagactntgccccctggagcctgtgcaggatgagctactctacgctcgggacctcatcaaagatgccaagaactcccgggcggtgagccctccacaggctacccttcccctgaagtctggagaacccaagaaggccgaccatgctaagccatgacagccctgccctgtgcatctgccttcctagcccagggaccccagagacctagcaagtcctggttctggcctgctaatcataaccccttccttctccagctgtttcccagcctctatgagctgggccacgtgctggccaatgatgggcctgtgcggcagaggctggaatcagtagcaagtgaggtgtccaaagctgtggacaaggagctgcaggcaagtcctggaggagggaggaatccatggtgggaacctagtgttgactgaggccctaagcccagagctaaagtcagagctgggagacttctggagggccaggaggacatgcagagttgagaccacccacgctcccactgtaccaaggcattgctgcaatatcaggcttggatttttttctgctagctttgatgttggtccctgaactctgacctccctgctctggatttggatccttggactgactgcccctgtctgtatggtagggtggaaggagcactgaccagaaagtggggaagccttagtgtccaaggctctgccactaacagttttgtgacttaggcaggtccctcagtctcagcaggaggggctggaatagataaagtctcttctgctgtggtgccagccctgatcctgtcccccttgggcctctggcctccctttcccccatactaggtgatcctggagtccatggtcagcctgacacaggagttatgccctgtggccatgcgggtggccgagggacacaacaagatgctgagcaatgtggcggagcgtgtcactgtgccccggaacttcatccgaggggcactgctggagcaagcaggacaggacattcagaacaagctggatgaagtgaagctctcagtcgtcacctacctaaccagctccatagtggatgagatcctgcaagagctctaccattcccacaagagcctggcccggcacctgacccagctaaggacgctgtcagatccaccagggtgcccaggccaagggcaggatctgtcctcccggggccgaggccggaaccatgaccatgaggagaccacagatgatgaacttgggaccaacattgacaccatggccatcaaaaagcagaaacgctgccgcaagattcggccggtgtctgccttcatcagcgggagccctcaggacatggaaagccaactggggaatctggggatcccccctggctggttctcaggacttgggggcagccagcccacagctagtggctcctgggaaggtctatctgagctgcccactcatggttacaaactaaggcatcaaacacaagggaggccccgcccccccaggaccacacctccaggacctggtcgacccagtatgccagcacctgggactcgtcaggagaatgggatggccacccgcctggatgaagggctggaggacttcttcagccgaagggtcctggaggaaagttctaggtgtgatgcctaaacacactcccattttcagcaggccccaaggccctagaagggctgctgtgtcctcccagctcccatgggagtctccataacagcagtgcccaaagccagtctctgtgagaaatttccccacattctcatccttccccacccagccctcagggcccatgacctctgcgtcttcccaggacagctgggaagaatggggccagagtgaaccaccacagtggggttggagagcaggtgtggatgagagggaggtggggggcagccctgggacaggatacccattagtggtgagaggcccggggggtagtgttccctgtcactgtcctgcagactgcccagggtctgtc

SEQ ID NO: 737330 - DNA, 4609 bp, Homo sapiens
  misc_feature (2112)..(2112): n is a, c, g, or t
  misc_feature (4318)..(4318): n is a, c, g, or t
ggagctcacccgcgagttgcaagacagcatccggaggtgcctgagccaaggggccgtgctccaacaacatcatgtgaagttggagacaaagcccaagaagtttgaggaccgagtgctggccctgacctcctggcgcctccacctcttcctccttaaagtcccggccaaggtggagagctccttcaatgtcctggagatccgtgccttcaacacgctcagtcagaatcagatcctggtggagacggagcgtggcatggtgagcatgcgactgccatcagctgaaagtgtggaccaggtgacacgacatgtgagctctgccctgtccaaggtctgccctggccctgggtgtttgatccggcgtggaaacgcagacaccccagaggggccccgagatacatcccccaactctgagacttccacatctaccacccacagtgtctgcggtggcttctctgagacctacgctgctctgtgtgactacaatgggctacactgccgtgaggaggttcaatgggatgtggacaccatctaccatgctgaagataaccgggagttcaatcttttggatttcagccacttggagagccgagacttggccctaatggtagcagccctggcctacaaccagtggttcaccaaactctactgcaaggacttgcggctgggctctgaagtgctagaacaggtgctacataccctaagcaagtcggggagcctcgaagagctggtgctggacaacgccgggcttaagacggactttgtccagaagctggccggggtgtttggggagaacgggagctgtgtgctgcatgccctcactctgtcccacaaccccatcgaggacaagggttttctcagtctgagccagcagctcctctgcttcccctctggcctcaccaaactgtgcctggccaagactgccatttcccctcgagggctccaggcactcggccagaccttcggggcaaacccagcatttgccagctcccttcgatacctggacctgagcaagaatcctgggctcctcgccacggatgaggccaatgccctctacagtttcctggcccaacccaacgccctggtgcacctggacctgtcaggaactgactgcgtcatcgacttgcttctcggtgccctgctccacggctgctgctcccacctcacctacctcaacctggctcgcaacagctgctcccacaggggtctctccacaggaagggtcgagaggccccgccggccttcaagcagttcttcagcagcgcctacacactgagccacgtcaatctgtcggccacaaagctgcccctggaggccctcagggcgctgcttcagggcctctccctcaacagtcacctcagtgacctgcacctggatctcagcagctgcgagctccgttcagcgggagcccaagccttgcaggagcagctgggagctgtcacctgtgtaggcagcctggatctgtcagacaatgggttcgactcggacctcctgacactggtgcctgcacttggcaagaacaagtccctcaagcacctgtttttgggcaagaacttcaatgtcaaggccaagaccctggaggagatcctccacaagctggtgcagctgatccaggaagaggactgttccctgcagtcactgtcggtggcagactcccggctgaagcttcgcaccagcatcctcatcaatgccctgggcagcaacacctgcctggccaaggtggatctgagcggcaatggcatggaggacatcggggccaagatgctgtctaaggccctgcagataaactcctccctcagaactatcctatgggatcggaacaatacatctgccctgggcttcctggacatcgcaagggccctggagagcaaccacacgctgcgcttcatgtccttccccgtgagcgacatctcccaagcctatcgcagcgcgcctgagcgcaccgaggacgtctggcagaagatccaatggtgcttagtgaggaacaaccactcccagacgtgcccccaggagcaggccttcaggttgcagcagggcctggtgaccagcagcgccgagcaaatgctgcagcggctgtgtggacgagtgcaggaggaggtgcgggccctgagactntgccccctggagcctgtgcaggatgagctactctacgctcgggacctcatcaaagatgccaagaactcccgggcggtgagccctccacaggctacccttcccctgaagtctggagaacccaagaaggccgaccatgctaagccatgacagccctgccctgtgcatctgccttcctagcccagggaccccagagacctagcaagtcctggttctggcctgctaatcataaccccttccttctccagctgtttcccagcctctatgagctgggccacgtgctggccaatgatgggcctgtgcggcagaggctggaatcagtagcaagtgaggtgtccaaagctgtggacaaggagctgcaggcaagtcctggaggagggaggaatccatggtgggaacctagtgttgactgaggccctaagcccagagctaaagtcagagctgggagacttctggagggccaggaggacatgcagagttgagaccacccacgctcccactgtaccaaggcattgctgcaatatcaggcttggatttttttctgctagctttgatgttggtccctgaactctgacctccctgctctggatttggatccttggactgactgcccctgtctgtatggtagggtggaaggagcactgaccagaaagtggggaagccttagtgtccaaggctctgccactaacagttttgtgacttaggcaggtccctcagtctcagcaggaggggctggaatagataaagtctcttctgctgtggtgccagccctgatcctgtcccccttgggcctctggcctccctttcccccatactaggtgatcctggagtccatggtcagcctgacacaggagttatgccctgtggccatgcgggtggccgagggacacaacaagatgctgagcaatgtggcggagcgtgtcactgtgccccggaacttcatccgaggggcactgctggagcaagcaggacaggacattcagaacaagctggatgaagtgaagctctcagtcgtcacctacctaaccagctccatagtggatgagatcctgcaagagctctaccattcccacaagagcctggcccggcacctgacccagctaaggacgctgtcagatccaccagggtgcccaggccaagggcaggatctgtcctcccggggccgaggccggaaccatgaccatgaggagaccacagatgatgaacttgggaccaacattgacaccatggccatcaaaaagcagaaacgctgccgcaagattcggccggtgtctgccttcatcagcgggagccctcaggacatggaaagccaactggggaatctggggatcccccctggctggttctcaggacttgggggcagccagcccacagctagtggctcctgggaaggtctatctgagctgcccactcatggttacaaactaaggcatcaaacacaagggaggccccgcccccccaggaccacacctccaggacctggtcgacccagtatgccagcacctgggactcgtcaggagaatgggatggccacccgcctggatgaagggctggaggacttcttcagccgaagggtcctggaggaaagttctagctacccccggactctgaggaccgtgcggccaggactctcggaggcaccgctgcctccactccagaagaagaggcgccggggcctgtttcactttcgccggccccggagcttcaagggggacagggggccggggtcccctaccactggactcctcctccctccacccccaccccctcccccgactcaggagagcccccctagcccagaccccccaagcctcggcaataactcctctccctgctggagcccagaggaggagagcagcctcctccctggatttggtgggggccggggaccttccttccgccggaagatggtaagtgaggcagggggtgctgtgtcttccccttttcctgccccacacttaacccagtctcctaccccaccccaagcttaatgggagaatgctaggacccagggttcttgggaacattggtcatttcaattctcctctccttgagagtggactaagacccagtggccaagagcatgctgggagtgctatatgcgaatgcaggcgttggaaggactcttcagagggtctctgcagggcttccccgtggctagggactcagtgaggcaggggtcctcctgacaactccctcacagcctggngagcccccttcgactgggaactgctaataaataagagaccttgttctagggcactgaggggtcagagccaggggaggggggcccagcccctgggacagcacagcagccaagggttcacggtgttgcccttcccgggttggaaagagccaagggttggagcttcgatgggaaacgagaggtgagtggagcctgggacaacaaactgtgggtcctgagggtatctgtccaccaccctctccttcccactccctcatccctggtggttcagtagagaaagcagatgctttggca

SEQ ID NO: 737331 - DNA, 5430 bp, Homo sapiens
  misc_feature (2112)..(2112): n is a, c, g, or t
  misc_feature (4318)..(4318): n is a, c, g, or t
ggagctcacccgcgagttgcaagacagcatccggaggtgcctgagccaaggggccgtgctccaacaacatcatgtgaagttggagacaaagcccaagaagtttgaggaccgagtgctggccctgacctcctggcgcctccacctcttcctccttaaagtcccggccaaggtggagagctccttcaatgtcctggagatccgtgccttcaacacgctcagtcagaatcagatcctggtggagacggagcgtggcatggtgagcatgcgactgccatcagctgaaagtgtggaccaggtgacacgacatgtgagctctgccctgtccaaggtctgccctggccctgggtgtttgatccggcgtggaaacgcagacaccccagaggggccccgagatacatcccccaactctgagacttccacatctaccacccacagtgtctgcggtggcttctctgagacctacgctgctctgtgtgactacaatgggctacactgccgtgaggaggttcaatgggatgtggacaccatctaccatgctgaagataaccgggagttcaatcttttggatttcagccacttggagagccgagacttggccctaatggtagcagccctggcctacaaccagtggttcaccaaactctactgcaaggacttgcggctgggctctgaagtgctagaacaggtgctacataccctaagcaagtcggggagcctcgaagagctggtgctggacaacgccgggcttaagacggactttgtccagaagctggccggggtgtttggggagaacgggagctgtgtgctgcatgccctcactctgtcccacaaccccatcgaggacaagggttttctcagtctgagccagcagctcctctgcttcccctctggcctcaccaaactgtgcctggccaagactgccatttcccctcgagggctccaggcactcggccagaccttcggggcaaacccagcatttgccagctcccttcgatacctggacctgagcaagaatcctgggctcctcgccacggatgaggccaatgccctctacagtttcctggcccaacccaacgccctggtgcacctggacctgtcaggaactgactgcgtcatcgacttgcttctcggtgccctgctccacggctgctgctcccacctcacctacctcaacctggctcgcaacagctgctcccacaggggtctctccacaggaagggtcgagaggccccgccggccttcaagcagttcttcagcagcgcctacacactgagccacgtcaatctgtcggccacaaagctgcccctggaggccctcagggcgctgcttcagggcctctccctcaacagtcacctcagtgacctgcacctggatctcagcagctgcgagctccgttcagcgggagcccaagccttgcaggagcagctgggagctgtcacctgtgtaggcagcctggatctgtcagacaatgggttcgactcggacctcctgacactggtgcctgcacttggcaagaacaagtccctcaagcacctgtttttgggcaagaacttcaatgtcaaggccaagaccctggaggagatcctccacaagctggtgcagctgatccaggaagaggactgttccctgcagtcactgtcggtggcagactcccggctgaagcttcgcaccagcatcctcatcaatgccctgggcagcaacacctgcctggccaaggtggatctgagcggcaatggcatggaggacatcggggccaagatgctgtctaaggccctgcagataaactcctccctcagaactatcctatgggatcggaacaatacatctgccctgggcttcctggacatcgcaagggccctggagagcaaccacacgctgcgcttcatgtccttccccgtgagcgacatctcccaagcctatcgcagcgcgcctgagcgcaccgaggacgtctggcagaagatccaatggtgcttagtgaggaacaaccactcccagacgtgcccccaggagcaggccttcaggttgcagcagggcctggtgaccagcagcgccgagcaaatgctgcagcggctgtgtggacgagtgcaggaggaggtgcgggccctgagactntgccccctggagcctgtgcaggatgagctactctacgctcgggacctcatcaaagatgccaagaactcccgggcggtgagccctccacaggctacccttcccctgaagtctggagaacccaagaaggccgaccatgctaagccatgacagccctgccctgtgcatctgccttcctagcccagggaccccagagacctagcaagtcctggttctggcctgctaatcataaccccttccttctccagctgtttcccagcctctatgagctgggccacgtgctggccaatgatgggcctgtgcggcagaggctggaatcagtagcaagtgaggtgtccaaagctgtggacaaggagctgcaggcaagtcctggaggagggaggaatccatggtgggaacctagtgttgactgaggccctaagcccagagctaaagtcagagctgggagacttctggagggccaggaggacatgcagagttgagaccacccacgctcccactgtaccaaggcattgctgcaatatcaggcttggatttttttctgctagctttgatgttggtccctgaactctgacctccctgctctggatttggatccttggactgactgcccctgtctgtatggtagggtggaaggagcactgaccagaaagtggggaagccttagtgtccaaggctctgccactaacagttttgtgacttaggcaggtccctcagtctcagcaggaggggctggaatagataaagtctcttctgctgtggtgccagccctgatcctgtcccccttgggcctctggcctccctttcccccatactaggtgatcctggagtccatggtcagcctgacacaggagttatgccctgtggccatgcgggtggccgagggacacaacaagatgctgagcaatgtggcggagcgtgtcactgtgccccggaacttcatccgaggggcactgctggagcaagcaggacaggacattcagaacaagctggatgaagtgaagctctcagtcgtcacctacctaaccagctccatagtggatgagatcctgcaagagctctaccattcccacaagagcctggcccggcacctgacccagctaaggacgctgtcagatccaccagggtgcccaggccaagggcaggatctgtcctcccggggccgaggccggaaccatgaccatgaggagaccacagatgatgaacttgggaccaacattgacaccatggccatcaaaaagcagaaacgctgccgcaagattcggccggtgtctgccttcatcagcgggagccctcaggacatggaaagccaactggggaatctggggatcccccctggctggttctcaggacttgggggcagccagcccacagctagtggctcctgggaaggtctatctgagctgcccactcatggttacaaactaaggcatcaaacacaagggaggccccgcccccccaggaccacacctccaggacctggtcgacccagtatgccagcacctgggactcgtcaggagaatgggatggccacccgcctggatgaagggctggaggacttcttcagccgaagggtcctggaggaaagttctagctacccccggactctgaggaccgtgcggccaggactctcggaggcaccgctgcctccactccagaagaagaggcgccggggcctgtttcactttcgccggccccggagcttcaagggggacagggggccggggtcccctaccactggactcctcctccctccacccccaccccctcccccgactcaggagagcccccctagcccagaccccccaagcctcggcaataactcctctccctgctggagcccagaggaggagagcagcctcctccctggatttggtgggggccggggaccttccttccgccggaagatggtaagtgaggcagggggtgctgtgtcttccccttttcctgccccacacttaacccagtctcctaccccaccccaagcttaatgggagaatgctaggacccagggttcttgggaacattggtcatttcaattctcctctccttgagagtggactaagacccagtggccaagagcatgctgggagtgctatatgcgaatgcaggcgttggaaggactcttcagagggtctctgcagggcttccccgtggctagggactcagtgaggcaggggtcctcctgacaactccctcacagcctggngagcccccttcgactgggaactgctaataaataagagaccttgttctagggcactgaggggtcagagccaggggaggggggcccagcccctgggacagcacagcagccaagggttcacggtgttgcccttcccgggttggaaagagccaagggttggagcttcgatgggaaacgagagggcccaggcccagaccaggagggcagcacccaggcctggcagaaacggcgctcttcagacgacgcagggcctggatcctggaagcccccaccaccgccccaaagcaccaaaccaagcttcagcgccatgcgcagagcagaggccacatggcacatagctgaagagagtgcccccaaccacagctgccagagtcccagcccagcctcccaagatggggaagaggagaaggaggggaccctcttcccagagaggacacttccagctaggaatgccaagctacaggaccccgctctagctccatggcctcccaagccagtggctgtgcccaggggccgccagcctccccaggagccaggggtcagggaggaggctgaggctggagatgcagctccaggagtcaacaaaccccggctgaggctgagctcacagcaagaccaagaggagcccgaagtccaagggccccctgatccaggccggcggactgcccccctgaagcccaagaggacacggcgggcacagtcctgtgacaagctggaacctgatagaagacggcctcctgaccccacaggaaccagtgagccaggaacagactgacaactgccacaacaccctcctcagccctcgacatgtgcctcgcaaggactcagacccctatccacccccagtccccagggccccctgccagcccctgtcctacaggggcaagacggcaggaccaggcatgggggagctggaggcagggactagaacagagggagccacctggagagacggaggctgtcagtgcctgcctcgatacctctctctgcagagagcttctgggtgggggcttatctcctcccccaggagggtggatctctgtccctctatccccagggactctctcccctcttgtatagaataaaaaaacaaaatcatcgcctaaaaaaagtct

SEQ ID NO: 737332 - DNA, 5082 bp, Homo sapiens
  misc_feature (2112)..(2112): n is a, c, g, or t
ggagctcacccgcgagttgcaagacagcatccggaggtgcctgagccaaggggccgtgctccaacaacatcatgtgaagttggagacaaagcccaagaagtttgaggaccgagtgctggccctgacctcctggcgcctccacctcttcctccttaaagtcccggccaaggtggagagctccttcaatgtcctggagatccgtgccttcaacacgctcagtcagaatcagatcctggtggagacggagcgtggcatggtgagcatgcgactgccatcagctgaaagtgtggaccaggtgacacgacatgtgagctctgccctgtccaaggtctgccctggccctgggtgtttgatccggcgtggaaacgcagacaccccagaggggccccgagatacatcccccaactctgagacttccacatctaccacccacagtgtctgcggtggcttctctgagacctacgctgctctgtgtgactacaatgggctacactgccgtgaggaggttcaatgggatgtggacaccatctaccatgctgaagataaccgggagttcaatcttttggatttcagccacttggagagccgagacttggccctaatggtagcagccctggcctacaaccagtggttcaccaaactctactgcaaggacttgcggctgggctctgaagtgctagaacaggtgctacataccctaagcaagtcggggagcctcgaagagctggtgctggacaacgccgggcttaagacggactttgtccagaagctggccggggtgtttggggagaacgggagctgtgtgctgcatgccctcactctgtcccacaaccccatcgaggacaagggttttctcagtctgagccagcagctcctctgcttcccctctggcctcaccaaactgtgcctggccaagactgccatttcccctcgagggctccaggcactcggccagaccttcggggcaaacccagcatttgccagctcccttcgatacctggacctgagcaagaatcctgggctcctcgccacggatgaggccaatgccctctacagtttcctggcccaacccaacgccctggtgcacctggacctgtcaggaactgactgcgtcatcgacttgcttctcggtgccctgctccacggctgctgctcccacctcacctacctcaacctggctcgcaacagctgctcccacaggggtctctccacaggaagggtcgagaggccccgccggccttcaagcagttcttcagcagcgcctacacactgagccacgtcaatctgtcggccacaaagctgcccctggaggccctcagggcgctgcttcagggcctctccctcaacagtcacctcagtgacctgcacctggatctcagcagctgcgagctccgttcagcgggagcccaagccttgcaggagcagctgggagctgtcacctgtgtaggcagcctggatctgtcagacaatgggttcgactcggacctcctgacactggtgcctgcacttggcaagaacaagtccctcaagcacctgtttttgggcaagaacttcaatgtcaaggccaagaccctggaggagatcctccacaagctggtgcagctgatccaggaagaggactgttccctgcagtcactgtcggtggcagactcccggctgaagcttcgcaccagcatcctcatcaatgccctgggcagcaacacctgcctggccaaggtggatctgagcggcaatggcatggaggacatcggggccaagatgctgtctaaggccctgcagataaactcctccctcagaactatcctatgggatcggaacaatacatctgccctgggcttcctggacatcgcaagggccctggagagcaaccacacgctgcgcttcatgtccttccccgtgagcgacatctcccaagcctatcgcagcgcgcctgagcgcaccgaggacgtctggcagaagatccaatggtgcttagtgaggaacaaccactcccagacgtgcccccaggagcaggccttcaggttgcagcagggcctggtgaccagcagcgccgagcaaatgctgcagcggctgtgtggacgagtgcaggaggaggtgcgggccctgagactntgccccctggagcctgtgcaggatgagctactctacgctcgggacctcatcaaagatgccaagaactcccgggcggtgagccctccacaggctacccttcccctgaagtctggagaacccaagaaggccgaccatgctaagccatgacagccctgccctgtgcatctgccttcctagcccagggaccccagagacctagcaagtcctggttctggcctgctaatcataaccccttccttctccagctgtttcccagcctctatgagctgggccacgtgctggccaatgatgggcctgtgcggcagaggctggaatcagtagcaagtgaggtgtccaaagctgtggacaaggagctgcaggcaagtcctggaggagggaggaatccatggtgggaacctagtgttgactgaggccctaagcccagagctaaagtcagagctgggagacttctggagggccaggaggacatgcagagttgagaccacccacgctcccactgtaccaaggcattgctgcaatatcaggcttggatttttttctgctagctttgatgttggtccctgaactctgacctccctgctctggatttggatccttggactgactgcccctgtctgtatggtagggtggaaggagcactgaccagaaagtggggaagccttagtgtccaaggctctgccactaacagttttgtgacttaggcaggtccctcagtctcagcaggaggggctggaatagataaagtctcttctgctgtggtgccagccctgatcctgtcccccttgggcctctggcctccctttcccccatactaggtgatcctggagtccatggtcagcctgacacaggagttatgccctgtggccatgcgggtggccgagggacacaacaagatgctgagcaatgtggcggagcgtgtcactgtgccccggaacttcatccgaggggcactgctggagcaagcaggacaggacattcagaacaagctggatgaagtgaagctctcagtcgtcacctacctaaccagctccatagtggatgagatcctgcaagagctctaccattcccacaagagcctggcccggcacctgacccagctaaggacgctgtcagatccaccagggtgcccaggccaagggcaggatctgtcctcccggggccgaggccggaaccatgaccatgaggagaccacagatgatgaacttgggaccaacattgacaccatggccatcaaaaagcagaaacgctgccgcaagattcggccggtgtctgccttcatcagcgggagccctcaggacatggaaagccaactggggaatctggggatcccccctggctggttctcaggacttgggggcagccagcccacagctagtggctcctgggaaggtctatctgagctgcccactcatggttacaaactaaggcatcaaacacaagggaggccccgcccccccaggaccacacctccaggacctggtcgacccagtatgccagcacctgggactcgtcaggagaatgggatggccacccgcctggatgaagggctggaggacttcttcagccgaagggtcctggaggaaagttctagctacccccggactctgaggaccgtgcggccaggactctcggaggcaccgctgcctccactccagaagaagaggcgccggggcctgtttcactttcgccggccccggagcttcaagggggacagggggccggggtcccctaccactggactcctcctccctccacccccaccccctcccccgactcaggagagcccccctagcccagaccccccaagcctcggcaataactcctctccctgctggagcccagaggaggagagcagcctcctccctggatttggtgggggccggggaccttccttccgccggaagatgggcactgaggggtcagagccaggggaggggggcccagcccctgggacagcacagcagccaagggttcacggtgttgcccttcccgggttggaaagagccaagggttggagcttcgatgggaaacgagagggcccaggcccagaccaggagggcagcacccaggcctggcagaaacggcgctcttcagacgacgcagggcctggatcctggaagcccccaccaccgccccaaagcaccaaaccaagcttcagcgccatgcgcagagcagaggccacatggcacatagctgaagagagtgcccccaaccacagctgccagagtcccagcccagcctcccaagatggggaagaggagaaggaggggaccctcttcccagagaggacacttccagctaggaatgccaagctacaggaccccgctctagctccatggcctcccaagccagtggctgtgcccaggggccgccagcctccccaggagccaggggtcagggaggaggctgaggctggagatgcagctccaggagtcaacaaaccccggctgaggctgagctcacagcaagaccaagaggagcccgaagtccaagggccccctgatccaggccggcggactgcccccctgaagcccaagaggacacggcgggcacagtcctgtgacaagctggaacctgatagaagacggcctcctgaccccacaggaaccagtgagccaggaacagactgacaactgccacaacaccctcctcagccctcgacatgtgcctcgcaaggactcagacccctatccacccccagtccccagggccccctgccagcccctgtcctacaggggcaagacggcaggaccaggcatgggggagctggaggcagggactagaacagagggagccacctggagagacggaggctgtcagtgcctgcctcgatacctctctctgcagagagcttctgggtgggggcttatctcctcccccaggagggtggatctctgtccctctatccccagggactctctcccctcttgtatagaataaaaaaacaaaatcatcgcctaaaaaaagtct

SEQ ID NO: 737333 - DNA, 4817 bp, Homo sapiens
  misc_feature (40)..(40): n is a, c, g, or t
  misc_feature (1499)..(1499): n is a, c, g, or t
  misc_feature (3705)..(3705): n is a, c, g, or t
gaggtcactctagagcgatccctagctggtcgcagtccangacttgcggtgggctctgaagtgctagaacaggtgctacataccctaagcaagtcggggagcctcgaagagctggtgctggacaacgccgggcttaagacggactttgtccagaagctggccggggtgtttggggagaacgggagctgtgtgctgcatgccctcactctgtcccacaaccccatcgaggacaagggttttctcagtctgagccagcagctcctctgcttcccctctggcctcaccaaactgtgcctggccaagactgccatttcccctcgagggctccaggcactcggccagaccttcggggcaaacccagcatttgccagctcccttcgatacctggacctgagcaagaatcctgggctcctcgccacggatgaggccaatgccctctacagtttcctggcccaacccaacgccctggtgcacctggacctgtcaggaactgactgcgtcatcgacttgcttctcggtgccctgctccacggctgctgctcccacctcacctacctcaacctggctcgcaacagctgctcccacaggggtctctccacaggaagggtcgagaggccccgccggccttcaagcagttcttcagcagcgcctacacactgagccacgtcaatctgtcggccacaaagctgcccctggaggccctcagggcgctgcttcagggcctctccctcaacagtcacctcagtgacctgcacctggatctcagcagctgcgagctccgttcagcgggagcccaagccttgcaggagcagctgggagctgtcacctgtgtaggcagcctggatctgtcagacaatgggttcgactcggacctcctgacactggtgcctgcacttggcaagaacaagtccctcaagcacctgtttttgggcaagaacttcaatgtcaaggccaagaccctggaggagatcctccacaagctggtgcagctgatccaggaagaggactgttccctgcagtcactgtcggtggcagactcccggctgaagcttcgcaccagcatcctcatcaatgccctgggcagcaacacctgcctggccaaggtggatctgagcggcaatggcatggaggacatcggggccaagatgctgtctaaggccctgcagataaactcctccctcagaactatcctatgggatcggaacaatacatctgccctgggcttcctggacatcgcaagggccctggagagcaaccacacgctgcgcttcatgtccttccccgtgagcgacatctcccaagcctatcgcagcgcgcctgagcgcaccgaggacgtctggcagaagatccaatggtgcttagtgaggaacaaccactcccagacgtgcccccaggagcaggccttcaggttgcagcagggcctggtgaccagcagcgccgagcaaatgctgcagcggctgtgtggacgagtgcaggaggaggtgcgggccctgagactntgccccctggagcctgtgcaggatgagctactctacgctcgggacctcatcaaagatgccaagaactcccgggcggtgagccctccacaggctacccttcccctgaagtctggagaacccaagaaggccgaccatgctaagccatgacagccctgccctgtgcatctgccttcctagcccagggaccccagagacctagcaagtcctggttctggcctgctaatcataaccccttccttctccagctgtttcccagcctctatgagctgggccacgtgctggccaatgatgggcctgtgcggcagaggctggaatcagtagcaagtgaggtgtccaaagctgtggacaaggagctgcaggcaagtcctggaggagggaggaatccatggtgggaacctagtgttgactgaggccctaagcccagagctaaagtcagagctgggagacttctggagggccaggaggacatgcagagttgagaccacccacgctcccactgtaccaaggcattgctgcaatatcaggcttggatttttttctgctagctttgatgttggtccctgaactctgacctccctgctctggatttggatccttggactgactgcccctgtctgtatggtagggtggaaggagcactgaccagaaagtggggaagccttagtgtccaaggctctgccactaacagttttgtgacttaggcaggtccctcagtctcagcaggaggggctggaatagataaagtctcttctgctgtggtgccagccctgatcctgtcccccttgggcctctggcctccctttcccccatactaggtgatcctggagtccatggtcagcctgacacaggagttatgccctgtggccatgcgggtggccgagggacacaacaagatgctgagcaatgtggcggagcgtgtcactgtgccccggaacttcatccgaggggcactgctggagcaagcaggacaggacattcagaacaagctggatgaagtgaagctctcagtcgtcacctacctaaccagctccatagtggatgagatcctgcaagagctctaccattcccacaagagcctggcccggcacctgacccagctaaggacgctgtcagatccaccagggtgcccaggccaagggcaggatctgtcctcccggggccgaggccggaaccatgaccatgaggagaccacagatgatgaacttgggaccaacattgacaccatggccatcaaaaagcagaaacgctgccgcaagattcggccggtgtctgccttcatcagcgggagccctcaggacatggaaagccaactggggaatctggggatcccccctggctggttctcaggacttgggggcagccagcccacagctagtggctcctgggaaggtctatctgagctgcccactcatggttacaaactaaggcatcaaacacaagggaggccccgcccccccaggaccacacctccaggacctggtcgacccagtatgccagcacctgggactcgtcaggagaatgggatggccacccgcctggatgaagggctggaggacttcttcagccgaagggtcctggaggaaagttctagctacccccggactctgaggaccgtgcggccaggactctcggaggcaccgctgcctccactccagaagaagaggcgccggggcctgtttcactttcgccggccccggagcttcaagggggacagggggccggggtcccctaccactggactcctcctccctccacccccaccccctcccccgactcaggagagcccccctagcccagaccccccaagcctcggcaataactcctctccctgctggagcccagaggaggagagcagcctcctccctggatttggtgggggccggggaccttccttccgccggaagatggtaagtgaggcagggggtgctgtgtcttccccttttcctgccccacacttaacccagtctcctaccccaccccaagcttaatgggagaatgctaggacccagggttcttgggaacattggtcatttcaattctcctctccttgagagtggactaagacccagtggccaagagcatgctgggagtgctatatgcgaatgcaggcgttggaaggactcttcagagggtctctgcagggcttccccgtggctagggactcagtgaggcaggggtcctcctgacaactccctcacagcctggngagcccccttcgactgggaactgctaataaataagagaccttgttctagggcactgaggggtcagagccaggggaggggggcccagcccctgggacagcacagcagccaagggttcacggtgttgcccttcccgggttggaaagagccaagggttggagcttcgatgggaaacgagagggcccaggcccagaccaggagggcagcacccaggcctggcagaaacggcgctcttcagacgacgcagggcctggatcctggaagcccccaccaccgccccaaagcaccaaaccaagcttcagcgccatgcgcagagcagaggccacatggcacatagctgaagagagtgcccccaaccacagctgccagagtcccagcccagcctcccaagatggggaagaggagaaggaggggaccctcttcccagagaggacacttccagctaggaatgccaagctacaggaccccgctctagctccatggcctcccaagccagtggctgtgcccaggggccgccagcctccccaggagccaggggtcagggaggaggctgaggctggagatgcagctccaggagtcaacaaaccccggctgaggctgagctcacagcaagaccaagaggagcccgaagtccaagggccccctgatccaggccggcggactgcccccctgaagcccaagaggacacggcgggcacagtcctgtgacaagctggaacctgatagaagacggcctcctgaccccacaggaaccagtgagccaggaacagactgacaactgccacaacaccctcctcagccctcgacatgtgcctcgcaaggactcagacccctatccacccccagtccccagggccccctgccagcccctgtcctacaggggcaagacggcaggaccaggcatgggggagctggaggcagggactagaacagagggagccacctggagagacggaggctgtcagtgcctgcctcgatacctctctctgcagagagcttctgggtgggggcttatctcctcccccaggagggtggatctctgtccctctatccccagggactctctcccctcttgtatagaataaaaaaacaaaatcatcgcctaaaaaaagtct

SEQ ID NO: 737334 - DNA, 903 bp, Homo sapiens
taatgtatatagtatagaggctagagactccttttctttgttacattgtgaactttatccccaaatggcaggcgtgcactggggctatgaagaaaccaagacttttcttgatatcctccgtgagactcggttttatgaagcgcttcaagcctgtcatcggaagagcaaattgtatggggctgtagctgaacagcttcgagagtgcggcttcctccggacaccagaacagtgccgaaccaagttcaaaagccttcagaagagttaccgcaaggtgaaaaatggccacgtgctagagtcctgcgcgttctacaaggagatggatgccctgattaactctcgggcatctgctccttcccccagcaccccagaggaagtcccatcaccttcaaggcaagaaagagggggtattgaggttgaaccccaggaacctacaggctgggaacctgaagagacctcacaggaggcagtaatagaagactcttgcagtgagagaatgagcgaggaggaaattgtgcaagagccagagttccagggacctccaggtctactgcagagcccaaatgattttgaaatcggaagtagcatcaaggaggatccaacacagatagtatataaggacatggaacagcatagggcattaatagaaaagtctaaaagagttgtttcccagagtaccgaccccagcaaatatcgcaaaagggaatgcatctcaggaagacaatgggaaaatcttcaaggaattagacagggaaagccgatgtctcagcctagagatttagggaaagccgttgtgcatcagaggccttttgtggggaagagaccctacagacttctcaaatatggagaaagctttggaaggagcactcgtctgatgtgccggatgacccaccacaaggagaatcc

SEQ ID NO: 737335 - DNA, 888 bp, Homo sapiens
cctggcctgtggccaaacaagatggagtggggaggaaggaaaggacagctggggaggggctggaggagaaggaagagaggccaggaaactcactgctccatcccttttgtgccttcttttctgtggatggtgttgtctctgccctgcccctctctcctgtctctcctctctgtgtcttggttctcaggttttcttctggaggcaaaaaattaaaccaaccatctcaggacaccctgactccaagaaacactcattgaagaagatggagaagactctccaggtggttgagactttgaggttggtcgagctcccaaaagaggctaagcccaagttgggtgagtcccccgagctggcagatccctgcgtgttggccaagactacagaggagaccgaggtggagctgggccaacagggccaatccctactgcagctgccgaggacggccgtcaagtctgtctccacgctcatggtctctgccctgcagagcggctggcagatgtgcagctggaagtcatcagtgagttctgcctcagtcagctcccaagtgaggacgcagtcacctttgaagactccggaggctgagttgctgtgggaggtgtacctggtgctgtgggccgttcggaaacacctgcgccggctgtaccgcaggcaggagaggcacagacggcaccacgtccgatgccatgctgccccccgacccaacccggctcagtccctgaaactggatgcccaaagtcccctctagggggaaccccagacccttagagagtcctgacctcactcttacctggggtcccatatcagccccttcattccatgtattccagttgtaaaacaagtatcaaaatattgggaaataaatatcagatagttctgaaaaaaaaaaaa

SEQ ID NO: 737336 - DNA, 1013 bp, Homo sapiens
actgtaggttctcacctacttcgactcctctccctgtcccagggaggggagaaaaggtctgggattcattgccaggaggggcttcccccaggatttcctacttctttctttactgctgtgcttgaagctcacaggagacccctcaagaggtggtcaccggcccacagcccaccccatcccccacccgccacccccaccgtaccaaatgctagctctgccctttcttctgtgtttttcccatcaagagagatggttgtggtcatgaagttcttccgatgggttagacgggcttggcaaaggattatttcctgggttttcttctggaggcaaaaaattaaaccaaccatctcaggacaccctgactccaagaaacactcattgaagaagatggagaagactctccaggtggttgagactttgaggttggtcgagctcccaaaagaggctaagcccaagttgggtgagtcccccgagctggcagatccctgcgtgttggccaagactacagaggagaccgaggtggagctgggccaacagggccaatccctactgcagctgccgaggacggccgtcaagtctgtctccacgctcatggtctctgccctgcagagcggctggcagatgtgcagctggaagtcatcagtgagttctgcctcagtcagctcccaagtgaggacgcagtcacctttgaagactccggaggctgagttgctgtgggaggtgtacctggtgctgtgggccgttcggaaacacctgcgccggctgtaccgcaggcaggagaggcacagacggcaccacgtccgatgccatgctgccccccgacccaacccggctcagtccctgaaactggatgcccaaagtcccctctagggggaaccccagacccttagagagtcctgacctcactcttacctggggtcccatatcagccccttcattccatgtattccagttgtaaaacaagtatcaaaatattgggaaataaatatcagatagttctgaaaaaaaaaaaa

SEQ ID NO: 737337 - DNA, 392 bp, Homo sapiens
  misc_feature (14)..(14): n is a, c, g, or t
cccacgcgtccgcngacgcgtgggtcgcccacgcgtcgggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaataaccaccttccccaaaccaaata

SEQ ID NO: 737338 - DNA, 699 bp, Homo sapiens
ctagttctagatcgcgagcggatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaataaccaccttccccaaaccaaata

SEQ ID NO: 737339 - DNA, 1221 bp, Homo sapiens
cgtggtcaaagaggctggtacggtccggattcctgcctagctgcctggcaccagccagaccctgctctgcccggggggctctgagccccccaggcattcccttcactgcatccctctccattgggggggtgtctaaggaccctttccccttgggcatggcccagccaggggtctctgtcaagtccctggtgtcgtcttatgagacccgagtggtggggatggctccggggctgccccgaaaaaggggctgtgcctcttccccttgctctccccggggtgcatcccccatccgagggacatctgggcccccgccccaccggggcctgggaggccctgggcagcggccttcaacccgcagggggatggacaaaaccctcctctccctcattctctactgtcacaggtacaggggggtgtgggcgggaggctgtggtccaagaaaccagcacctgggaaggcttctcctctcctcccctcaccttcctgtgtctctccagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaataaccaccttccccaaaccaaata

SEQ ID NO: 737340 - DNA, 1127 bp, Homo sapiens
cgtggtcaaagaggctggtacggtccggattcctgcctagctgcctggcaccagccagaccctgctctgcccggggggctctgagccccccaggcattcccttcactgcatccctctccattgggggggtgtctaaggaccctttccccttgggcatggcccagccaggggtctctgtcaagtccctggtgtcgtcttatgagacccgagtggtggggatggctccggggctgccccgaaaaaggggctgtgcctcttccccttgctctccccggggtgcatcccccatccgagggacatctgggcccccgccccaccggggcctgggaggccctgggcagcggccttcaacccgcagggggatggacaaaaccctcctctccctcattctctactgtcacagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaataaccaccttccccaaaccaaata

SEQ ID NO: 737341 - DNA, 975 bp, Homo sapiens
  misc_feature (14)..(14): n is a, c, g, or t
cccacgcgtccgcngacgcgtgggtcgcccacgcgtcggatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaataaccaccttccccaaaccaaata

SEQ ID NO: 737342 - DNA, 988 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctcccgttagtctaaactggggggatcctc

SEQ ID NO: 737343 - DNA, 2527 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaataaccaccttccccaaaccaaata

SEQ ID NO: 737344 - DNA, 2291 bp, Homo sapiens; identical to SEQ ID NO: 342672

SEQ ID NO: 737345 - DNA, 2078 bp, Homo sapiens; identical to SEQ ID NO: 342673

SEQ ID NO: 737346 - DNA, 2910 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggtaagagaagccatcttggtcccaggaggtcctggcccccttaagccatccctctgccccagccctgtcctcttccttaccagggaacaccaactcccagctcctccgtccctctccctgctgggctgctgggcatcctctgccccctcctgccaccacctccacccttgactttgcccagcctctagtctggctactggtccccatctctgtctttgagccctgactctgcctctgtccctcgtccttttcccctgtcccttccctgctttgtccctcatcctctggacactggggactgtctcccaccccagccctcaaggcactgggcaggggatgaggcacccaccccgttgacgctgtgcctgtcccggggcccccaggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaataaccaccttccccaaaccaaata

SEQ ID NO: 737347 - DNA, 2264 bp, Homo sapiens; identical to SEQ ID NO: 342671

SEQ ID NO: 737348 - DNA, 2620 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatgagagatggttgtggtcatgaagttcttccgatgggttagacgggcttggcaaaggattatttcctgggttttcttctggaggcaaaaaattaaaccaaccatctcaggacaccctgactccaagaaacactcattgaagaagatggagaagactctccaggtggttgagactttgaggttggtcgagctcccaaaagaggctaagcccaagttgggtgagtcccccgagctggcagatccctgcgtgttggccaagactacagaggagaccgaggtggagctgggccaacagggccaatccctactgcagctgccgaggacggccgtcaagtctgtctccacgctcatggtctctgccctgcagagcggctggcagatgtgcagctggaagtcatcagtgagttctgcctcagtcagctcccaagtgaggacgcagtcacctttgaagactccggaggctgagttgctgtgggaggtgtacctggtgctgtgggccgttcggaaacacctgcgccggctgtaccgcaggcaggagaggcacagacggcaccacgtccgatgccatgctgccccccgacccaacccggctcagtccctgaaactggatgcccaaagtcccctctagggggaaccccagacccttagagagtcctgacctcactcttacctggggtcccatatcagccccttcattccatgtattccagttgtaaaacaagtatcaaaatattgggaaataaatatcagatagttctgaaaaaaaaaaaa

SEQ ID NO: 737349 - DNA, 2503 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaataaccaccttccccaaaccaaata

SEQ ID NO: 737350 - DNA, 2424 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaataaccaccttccccaaaccaaata

SEQ ID NO: 737351 - DNA, 1521 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatgctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaataaccaccttccccaaaccaaata

SEQ ID NO: 737352 - DNA, 1496 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaataaccaccttccccaaaccaaata

SEQ ID NO: 737353 - DNA, 2382 bp, Homo sapiens
  misc_feature (53)..(53): n is a, c, g, or t
taaacacatccaccaacaatacgacgcgcagattgtactatgaaccgtgttanagcaggtgtacggccggaattttgggatccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaataaccaccttccccaaaccaaata

SEQ ID NO: 737354 - DNA, 314 bp, Homo sapiens
  misc_feature (140)..(140): n is a, c, g, or t
  misc_feature (149)..(149): n is a, c, g, or t
  misc_feature (159)..(159): n is a, c, g, or t
aattaagtttgcattttggataaacagtgaagaagttcctagtgtaagtatgtcccagttctatgtggctgccctacctgggcttgcctctgctggtactagctgcccagagaccttcaggcctgccacgggctgccggnacctctttnggatttcttntaagtaactgctccatactcccctgccttccccttggccatcaagatgatgtggaacatctcggcaggttcctccagcgaagccatcttgaacacaatgagccaggagctggtcccagcgagccgagtggccttggctggggagtatggagcagt

SEQ ID NO: 737355 - DNA, 726 bp, Homo sapiens
gaaagatcagagactcttttgctaggctgttgaagttcgaggtgaaatcatcttttcttcacttgttaactgaaggcaaacccttcgaaatatcctggccttgttgttcatgttgtttttgcatttttatcatcagggtcacttttgttatagatttgtcatagtgtggatcaacctgcattcttgtcagggtttgcaagcctccctgccaacgtgctgatccagtgcctgtcctggagttacccacctcatcctggtctgtctttcttagaacaatgactttctagctctagcctaatacaataatttgtttggtggtttaaaggagttggccaagaaacacaggcaagagctagcattcccaaacttaatccttaatctgtttgtcttacttgtttatggagaaaaacagaaacaaaatcaccctaagattgtgctatctgaaaccaaaacacctccaggaagatgttccaggctgaatgtcccaccccccttccctccccctgctacccctccaattcacatgttgaagttctaatgcccagtacctcagaatgagactgtgtttggagacagggtctttatagaggtacttaagttagaataaggttattaggatgggctttatccaatatggtgagtgttcttataagaggaggaaatttagatacagacacgagcagagggaagaccctcttcatgagaagacacagaaagcagacagcc

SEQ ID NO: 737356 - DNA, 487 bp, Homo sapiens
tttgatttttgttctatgccaaaggctttatgaacaaggggttaagataatgtgtatgaatgttgtacttctcccctgtattgtaggactggcgggagctgtgggtagacgatgccatctggcgcttgctgttctccatgatcctctttgtcatcatggttctctggcgaccatctgcaaacaaccagagcttggggtttattaaaacataggttgctgttcccttcgagtttcagattcagtagaactggaatgggcctgaaactttgcatttctaacaagttcacaggtgctgctgctactgctgttgttgctggtctagaaccactttcagaaccactggctgagagcttagtgggtgtcaggtgttgctaagcgctcacgacactaggtcacaggtatttacaaaaattttgcagattaggaaagtatggcatcgaaatattaaattttctaaatcacagctaatttcctaattggtagatct

SEQ ID NO: 737357 - DNA, 639 bp, Homo sapiens
tttgatttttgttctatgccaaaggctttatgaacaaggggttaagataatgtgtatgaatgttgtacttctcccctgtattgtaggactggcgggagctgtgggtagacgatgccatctggcgcttgctgttctccatgatcctctttgtcatcatggttctctggcgaccatctgcaaacaaccagagccagaggttcttggactcttctgtttactctgagttaaggtgtattacaacaaaatggtgatagcaggtagagtctggggaaatctgtattttctttcctggtgttcggtctctcttcttatgatccaggattcatgtcactgggtatacaccttggggtttattaaaacataggttgctgttcccttcgagtttcagattcagtagaactggaatgggcctgaaactttgcatttctaacaagttcacaggtgctgctgctactgctgttgttgctggtctagaaccactttcagaaccactggctgagagcttagtgggtgtcaggtgttgctaagcgctcacgacactaggtcacaggtatttacaaaaattttgcagattaggaaagtatggcatcgaaatattaaattttctaaatcacagctaatttcctaattggtagatct

SEQ ID NO: 737358 - DNA, 705 bp, Homo sapiens
tttgatttttgttctatgccaaaggctttatgaacaaggggttaagataatgtgtatgaatgttgtacttctcccctgtattgtaggactggcgggagctgtgggtagacgatgccatctggcgcttgctgttctccatgatcctctttgtcatcatggttctctggcgaccatctgcaaacaaccagagccagaggttcttggactcttctgtttactctgagttaaggtgtattacaacaaaatggtgatagcaggtagagtctggggaaatctgtattttctttcctggtgttcggtctctcttctgaggaagtacatcaagtcagttcttttccccagcaacaaaaatgtagtaacacattgtttctgtcttatgatccaggattcatgtcactgggtatacaccttggggtttattaaaacataggttgctgttcccttcgagtttcagattcagtagaactggaatgggcctgaaactttgcatttctaacaagttcacaggtgctgctgctactgctgttgttgctggtctagaaccactttcagaaccactggctgagagcttagtgggtgtcaggtgttgctaagcgctcacgacactaggtcacaggtatttacaaaaattttgcagattaggaaagtatggcatcgaaatattaaattttctaaatcacagctaatttcctaattggtagatct

SEQ ID NO: 737359 - DNA, 1064 bp, Homo sapiens
agaattcggcacgaggattctgatgttgatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaatgtatttttctcatttttttcaaactttttctaaagactctttctgtcaaactcatgaaaaatttctttctatggcttttattctagattgtcttattttctgttaaaaccaatgaccacatgaccacaatcttcactaactcatactgcagtgaaagtgttaacccttaggtagtttctctacaactctttgctatggtgattttaaaaaaagtttcctaggaagtatctctgaggaacagcaatctgaagaactgactatattctcatgctaagtcattagccaaaagctggtggtattgttgcatgctgctattgcatattaaaacgtagcagatgaataatagttgtaatgcagcaggatagttggtcaaattatttttttagg

SEQ ID NO: 737360 - DNA, 591 bp, Homo sapiens
  misc_feature (13)..(13): n is a, c, g, or t
  misc_feature (23)..(23): n is a, c, g, or t
cctagaacctagnggatcccccngggctgcagggaattcgggcacgagctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagcccttggggtttattaaaacataggttgctgttcccttcgagtttcagattcagtagaactggaatgggcctgaaactttgcatttctaacaagttcacaggtgctgctgctactgctgttgttgctggtctagaaccactttcagaaccactggctgagagcttagtgggtgtcaggtgttgctaagcgctcacgacactaggtcacaggtatttacaaaaattttgcagattaggaaagtatggcatcgaaatattaaattttctaaatcacagctaatttcctaattggtagatct

SEQ ID NO: 737361 - DNA, 565 bp, Homo sapiens
atctgtgcttcaaaccattccctacagaaaccattccctcaggtaacctcttacaaagttggaacattttcacagtccatctctcctccctagggaaaagctaggatttggggatgttggggattctacctgcttactctacactgagctgggggagcggctgtagtgagctcatgcttgctagtccaaacttccactttgatttcagcaacttccaacctgggccctttgtttttagctctcggactcaggcaagacagaaaacagtctctcgtgcaggttctagaaaagtcagaatgttggatgtacattccagtcatttccttccctctgcaaaaagaagctgggagctgagggtttcctctctatcatgtggtactgtgctgggtccatgggaagggaagaattatggcaagagggtgcctcaggtttttctgccgactttgattcagctggtttcatgctttcctatagtgcagaagaccctcaactggtttctggatttcccacaaagggaatttttccatgtattattgaatcagtgtgtctgtagagggaaggagtg

SEQ ID NO: 737362 - DNA, 478 bp, Homo sapiens
ggacagatagaatcgagccggaccctagtctagaagttcaatcgcagacatctgtttttcaccacttctttttctttgtctgcaggcccagactgatcttgcttccttggcctttatccccttggctttcctagacactgccttgtgctggtggatatccttctcattggcttgtttgatgatggtccattttctccccttggagatgggtttccattgatctttctgcaaagagtttttatcagttttgttaattactccttagtgtggggaacagtgcatgctaagtcttaacaacctgagggttcaggtaagcagttttttttgtttctatttttttaattttaaaaatcaaattggaaattggtgactgtggaccgagctcgagataaaatcttttggcttttttcttttaagtgagcatttcatcttgattttgcacttcttgtttgtgtacctaatcatttagtgttagagt

SEQ ID NO: 737363 - DNA, 376 bp, Homo sapiens
gtaagtaaccagaaaatctttgccagttcgagtggttggaaggtgagatgtatgaaaatattcctaaggtcagcagtcactacataggcttaacttttcaattacttaattattacaatatcttaagcagaatcactatgactctgacttttgtttttaatcttatgagttcagtgatgtaagactaattttactgaaatatgctcacaaaagtcacaacagtagtgaccattttgggaatgattattaacatcaaatctcaatttctgttgatttctaaggcaccattatacatctaagaaaaaaagtaaagctgtcaatttaattgtaaaatgtcactgattgtaagacacaccttgatttaaaaaacctcaaa

SEQ ID NO: 737364 - DNA, 348 bp, Homo sapiens
gtaagtgactttatattatttaacctcagtattggatggttttgggttcaaagattgtcccatgttttgtggcagtattctttttaatgaattgttcctgtgcaattcagaaaatgttgcttgtagtcctggatttatttcttattagactgggactttgagagagtcagtatacccttgtgtgcctcattttcttatccatataatgaaggggtcagtgacctgtggaaatacctcaaagatcatctcacattctctctaggatgcatgagccaccatgcctggcctaatttttattttttgtagggacagagtcttgctatgttgcctagactggccttgaactca

SEQ ID NO: 737365 - DNA, 429 bp, Homo sapiens
ctagaggatcccccttttggggtctatgtttcacagaatccagtgtccccgggttggataagaaagatatgtaaataggagtcttcatttctttctttctttttcttcctctgcacatcttggtccctgggtaattctgcttacgagatggttcgacttcgcttcaactttggaatggctattctaagctttactgtgtgactagaaagcatagagatttaagaaatgtgttttaacatgggaatggttaaaatggaagaaatagtacttaaaatttaatgtggtaaggctagtctttcatttggataattaactacatgggttgactctttctgccccttacccattttaaaccttatttcagtaacaggtatagtcctgtgagcagacaaaaaccagatgcagggaggaaatgctgaaaagcattag

SEQ ID NO: 737366 - DNA, 979 bp, Homo sapiens
acaaggtgagccgaagaaacaagtggtcctatttatatgcagtcgatcatttaacaagcacccttctgtagaaggaagaaagagaattccttatatgccctatcatgatgatgatggtgaaaaagataacaataaatggatcaatctagattacctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtacggacgcgtggtcgacgattcccggaaattccggc

SEQ ID NO: 737367 - DNA, 1736 bp, Homo sapiens
atctaataattttaaatggatagttaaaatgaggtgagagagcatgtgttttgctcccttagaagtatttaagacatgccagtgggtggtacatgcatatagccccagctactcagtggggctgaggcaagaggattgcttgagcctagtagtttgaggttacagtgtgccatgactgcacctgtgagtaaccactgcactccagcctgagcaacacagtgagaccccatctctttaaaaaatttaagatgtgttaatatccaattacacagagaagctgagataaatcctcagagaaaagaataaattttggaggttcattttagtactacaagcctctactcagtttttcacatacctttacttagaagcccgcctctcagtctgggaaaaagagtattaattctctttttctatcttatttctcccttattaaataaaaacaattaaaacttggtggtttgttatccacaaatctagtttttttaatggccatataggcgaaaataccagatattttgtaaacatcatggtggtagaaatagctttgtctatgtcttcaagcatagtgttgatcacaattacattaaaacaaaaactttttattcacccagaactgggaatcacaattagtaaagaccataatagaattaacaaacagccctagaacacatatttaaatttgcagtgggtgttaagtaggaaaattatgactccatcaactcttccttggtaggttgatcttgcttttcctgaggcaccaggactcttcactgttatgtaaagaactgttaacctaaaagacatagaacagtgagtggccacctctaccagctgtgatcaagacctcccgggatccagaggatggtctaatagttcattaaattgctgtaggacactaattgtcccttctacagttgcagccagttggtttattgcaagcactgattttctacaaagaatactggcaacctcacgctgggcactggcctgttccccaaggacaactggcctgtccaggtgtgcttctgattgtctggccagttcccaaattagctgcctgttcctggccatttctgcagacacagtactggctaataagcggtagttgtgcctcatctgctgagaaggtggctggttgggcaaagcttcattttcattaggcttagatgaagaggcaaggggtaacttcacagaggtgctcagagatattcctgcatcctcggagaagctgctggaagtgttgtctctggtgaaaccttgcaaacaggctgagcatggagtttgttccaagaggtcctcaaagttctcagtcttgggagctacgttgctgatgtcccaggtaatttgtccttgtttatcaggctcctcagcttccttttgagccaggtgctgtcttgtgctgagatcctgtgtctcctcctggactgtggtttctttgcctttgaaggcatccagagttgttgggctctggtcctggcacctgaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacactaaataaaaagacattttgagaaatttatttcacacagggcttgtgaatccaacttttgtaccttctctaacgac

SEQ ID NO: 737368 - DNA, 3134 bp, Homo sapiens
atctaataattttaaatggatagttaaaatgaggtgagagagcatgtgttttgctcccttagaagtatttaagacatgccagtgggtggtacatgcatatagccccagctactcagtggggctgaggcaagaggattgcttgagcctagtagtttgaggttacagtgtgccatgactgcacctgtgagtaaccactgcactccagcctgagcaacacagtgagaccccatctctttaaaaaatttaagatgtgttaatatccaattacacagagaagctgagataaatcctcagagaaaagaataaattttggaggttcattttagtactacaagcctctactcagtttttcacatacctttacttagaagcccgcctctcagtctgggaaaaagagtattaattctctttttctatcttatttctcccttattaaataaaaacaattaaaacttggtggtttgttatccacaaatctagtttttttaatggccatataggcgaaaataccagatattttgtaaacatcatggtggtagaaatagctttgtctatgtcttcaagcatagtgttgatcacaattacattaaaacaaaaactttttattcacccagaactgggaatcacaattagtaaagaccataatagaattaacaaacagccctagaacacatatttaaatttgcagtgggtgttaagtaggaaaattatgactccatcaactcttccttggtaggttgatcttgcttttcctgaggcaccaggactcttcactgttatgtaaagaactgttaacctaaaagacatagaacagtgagtggccacctctaccagctgtgatcaagacctcccgggatccagaggatggtctaatagttcattaaattgctgtaggacactaattgtcccttctacagttgcagccagttggtttattgcaagcactgattttctacaaagaatactggcaacctcacgctgggcactggcctgttccccaaggacaactggcctgtccaggtgtgcttctgattgtctggccagttcccaaattagctgcctgttcctggccatttctgcagacacagtactggctaataagcggtagttgtgcctcatctgctgagaaggtggctggttgggcaaagcttcattttcattaggcttagatgaagaggcaaggggtaacttcacagaggtgctcagagatattcctgcatcctcggagaagctgctggaagtgttgtctctggtgaaaccttgcaaacaggctgcaaaagaaaataaacgtgttgccaaatggtcacctatatcatgagaaagcatcataattagcaatataaagtagattgctccagacatccttgctagcaatgctatttaagctagactcacaagacagcatacattttcctttgcctagatcacaagactagatctctctttctcaatccagaccaaattttcactgacgatagaaaactaatagtagtaggaaaacaacaacaacaactgagttctacaaaagcagtcaacactttcctgatcactttctattttctggaaacttctttactaaatatctacctgattattctgtcatcaggaataagcacaacactatattaggaccctatgtgagaaaacttatgcatctgaacatgcaaccagcttttctccaaagcctggacgttccgaccttgcaacaacacacaggtcaacattctagcttgttttggaacagatctatgtcctggaacatcatgtttgctatggactgaatggtgtcttcccaaagtttcctattaaagccctaacccacaatatgatggtattcagagatgaagcccttgggaggtaattaggtttagatgaggtaacgaggttgaggaagtcctcaggaatggattagtgcccttataagaaaagacgggagagcttgtgtacacactctctctccactatgcgagggcacaagaagaaggcagccatctacaaaccaagaagagagccctcaccagacagtgaagctgctagcaccttgatcttggaatttacagccttcagaactgcgagaaataaacatctgttgtgtaagctgcctagcctgtgatatttggttatggcagcctaacccaatgttgaatgaagcttggttctgcttcctggttgtttattaaggagcagactggggaagggaattgagagggagaaattcaaaaattaacaaatcttgacaactccaaagttactgctttaagggttttaaaggtgtaggggcaggcaggcaccaagagtgttggatttgtcagaatctgcctgatcagtgtaatttgagaactgcagctgtgagctgaatatgatcctcttagactctgggctgtccctcttgacctgaaataaaaagctatcattctgaataagtggatgtatgcagcttattttaaaacttcagatcacactcataccatatcttaatgtgcaatctccttgaaacacccatcttatcccagaaaccatttttaatagaagttctttgttattaaaaatttttttttttttccatgctgtctttgtcatgttttaggtcaattttttttggacagtgtctgtgttgcccaggcagcagtgtagtggcacaatcttggctcactgcaacctctgcctcccagggtcaagtgattctcatgtctcagcctttggagtagctgggattacaggcatgcatcaccctgcctggctaatttttgtatttttagaagagatggggttttgccatgttggccatagctggtctcaaactcctggcctcaagcgatctgcctgctttggcctcccaaagtgctgggattataggtgtgagccaccacgcctggcctaatagaggctctttcactatgcaatgagctgcatataagatgcaggcaacattagtgatcaccatcacctctgttgtctctaacagactgacagagggcatgaaaccttatgtacctactagtcatctcaacaccacatgacaaggaggacattaaaatggagttcagtgcagaatttcagggtgatctcccgaaatatgtatttgcatacatttgcctgagatcagggcatgcagattccctatgtggttctga

SEQ ID NO: 737369 - DNA, 2257 bp, Homo sapiens
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacaacgacgtgtttggaatgatgatagatcacgaataaaactctgtgactaagtcggaaagggagccagttcctcttaatgggaacccaccactttgctggaatcaacttgagaaattctcagcaaaaatatctggcagggcatttactcagcagttgttgcatttaaccttttcctcaggtttctacttggcaggggaaccttagtaaagagccctca

SEQ ID NO: 737370 - DNA, 519 bp, Homo sapiens
aaacaaagcacaattcaaagataaggttgttatctatcaagggggtttagttgctgaagtaccaataaggtctctaaagtaatttgatgggataaattcttaagatatcatcagaagcagaatgaaagcaaacatctttttctttcttctagctcagtacactttctggcagccctggagtctattttgcaagttcacctccagggattaccacatcctttatacggcaggtttgtgaagcaagagaaacaatcacagaacagtccaggaaatagtgctgaaggaacataatacacactcacaacgacgtgtttggaatgatgatagatcacgaataaaactctgtgactaagtcggaaagggagccagttcctcttaatgggaacccaccactttgctggaatcaacttgagaaattctcagcaaaaatatctggcagggcatttactcagcagttgttgcatttaaccttttcctcaggtttctacttggcaggggaaccttagtaaagagccctca

SEQ ID NO: 737371 - DNA, 229 bp, Homo sapiens
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgactttcagtaactgttagctgtgattagttagctggtggatttaattgattaaaaaattacgattgaatgta

SEQ ID NO: 737372 - DNA, 4302 bp, Homo sapiens
  misc_feature (2941)..(2941): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctatagatacggagtatgcagatgcttgataattatttgtgattgtcagtatccaaaagactatattatcatgtggaagtcattaaaattcactatgatattcagtgaatttcagggcacaaaca

SEQ ID NO: 737373 - DNA, 6221 bp, Homo sapiens
  misc_feature (2941)..(2941): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgtaaataggagtcttcatttctttctttctttttcttcctctgcacatcttggtccctgggtaattctgcttacgagatggttcgacttcgcttcaactttggaatggctattctaagctttactgtgtgactagaaagcatagagatttaagaaatgtgttttaacatgggaatggttaaaatggaagaaatagtacttaaaatttaatgtggtaaggctagtctttcatttggataattaactacatgggttgactctttctgccccttacccattttaaaccttatttcagtaacaggtatagtcctgtgagcagacaaaaaccagatgcagggaggaaatgctgaaaagcattag

SEQ ID NO: 737374 - DNA, 6968 bp, Homo sapiens
  misc_feature (2941)..(2941): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagtaagtattaacttcctgtatggaagagcaaattaaaatgctgattaaattaaaacagtattgcatgttcccaatgtagtagttctgaaatagttgataaaagaaataattctgaaacaagaaaggtatttgaaattttgtagcattgtaaatgttgggaaaatgtgtttcattttccatacttccaaatatattccatacttccaaatatattccatacttccaagtccaaatgtattccatacttccaaatccaaatgtattccatacttccgaatatat

SEQ ID NO: 737375 - DNA, 7157 bp, Homo sapiens
  misc_feature (2941)..(2941): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatccttctcattggcttgtttgatgatggtccattttctccccttggagatgggtttccattgatctttctgcaaagagtttttatcagttttgttaattactccttagtgtggggaacagtgcatgctaagtcttaacaacctgagggttcaggtaagcagttttttttgtttctatttttttaattttaaaaatcaaattggaaattggtgactgtggaccgagctcgagataaaatcttttgtgagcatttcatcttgattttgcacttcttgtttgtgtacctaatcatttagtgttagagt

SEQ ID NO: 737376 - DNA, 7606 bp, Homo sapiens
  misc_feature (2941)..(2941): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagagccagaggttcttggactcttctgtttactctgctaacatgagatgaccatgtcatcaattaggggtggtgcattgggggacagtatcagggctgtgtcatatagtggaaggaacactgggcctggaatcagaagaactgggttcctatctcagctctcctcttaacttcatgatttttggcatgcggcctctccacctctctggccttagtttcctttctatatactgagggggaattaaacccagcaacatgaagttcctttcagctctgacattttgtgataaatacacaggcatactatggaaataaattgcaagtttggtttcagaccatcacgataaagcagatattgagttacatacatattttgttttttccagtgcatatcaaagttatgtttacactattctgtagtctactatgtgtgcaatagcattatgtctaaaaaatatatgcacgttaatttaaaaacactttattgcca

SEQ ID NO: 737377 - DNA, 8955 bp, Homo sapiens
  misc_feature (2941)..(2941): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaatgtatttttctcatttttttcaaactttttctaaagactctttctgtcaaactcatgaaaaatttctttctatggcttttattctagattgtcttattttctgttaaaaccaatgaccacatgaccacaatcttcactaactcatactgcagtgaaagtgttaacccttaggtagtttctctacaactctttgctatggtgattttaaaaaaagtttcctaggaagtatctctgaggaacagcaatctgaagaactgactatattctcatgctaagtcattagccaaaagctggtggtattgttgcatgctgctattgcatattaaaacgtagcagatgaataatagttgtaatgcagcaggatagttggtcaaattatttttttagg

SEQ ID NO: 737378 - DNA, 8880 bp, Homo sapiens
  misc_feature (2941)..(2941): n is a, c, g, or t
  misc_feature (8570)..(8570): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaaaaaaaanaaaaaaaaaaaacacaaaaagagagacgagaaaaaaaaaaggggggggggggcggcaagagagtcccccggggggggccaggtagggggcccgagctttttgggaaaaggggggccacaaagagagaacaaataaaaacgcaacagggccaggataaaaaacgggaaggggaaacaggcacggggaactgggagaggccactaaacggggggggacaaaatgggaaaacacacaaaataaaaccccgggaaataaaataaaggaaggggcaaaccagaaaaagaggtaaaaatgaaaaaataaagaaata

SEQ ID NO: 737379 - DNA, 8099 bp, Homo sapiens
  misc_feature (2941)..(2941): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaactcgaggtcgacggttccataagcttgtatttaaattcgcagctttcttacgggaagggaaaactttattcttaaaaagtggccccctaaaggttgttggcctttccccccccaaaaatttttttttacaaaaccaaaaaaaagg

SEQ ID NO: 737380 - DNA, 7946 bp, Homo sapiens
  misc_feature (2941)..(2941): n is a, c, g, or t
  misc_feature (7827)..(7827): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaanaaaaaaaaaaaaaaaaattctcttttcctcaaattaaaaaagaggaagagtttttacagagattataaactatttcagggcttagttacctctaattaaacctttctgcgttacaagaa
